(12) United States Patent
Prakash et al.

(10) Patent No.: US 9,994,855 B2
(45) Date of Patent: Jun. 12, 2018

(54) COMPOSITIONS AND METHODS FOR MODULATING GROWTH HORMONE RECEPTOR EXPRESSION

(71) Applicant: Ionis Pharmaceuticals, Inc., Carlsbad, CA (US)

(72) Inventors: Thazha P. Prakash, Carlsbad, CA (US); Punit P. Seth, Carlsbad, CA (US); Eric E. Swayze, Encinitas, CA (US); Sanjay Bhanot, Carlsbad, CA (US); Susan M. Freier, San Diego, CA (US); Huynh-Hoa Bui, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days. days.

(21) Appl. No.: 15/307,990

(22) PCT Filed: May 1, 2015

(86) PCT No.: PCT/US2015/028887
§ 371 (c)(1),
(2) Date: Oct. 31, 2016

(87) PCT Pub. No.: WO2015/168618
PCT Pub. Date: Nov. 5, 2015

(65) Prior Publication Data
US 2017/0166899 A1    Jun. 15, 2017

Related U.S. Application Data

(60) Provisional application No. 61/987,470, filed on May 1, 2014, provisional application No. 62/061,071, filed on Oct. 7, 2014, provisional application No. 62/082,511, filed on Nov. 20, 2014.

(51) Int. Cl.
*C12N 15/113* (2010.01)

(52) U.S. Cl.
CPC ...... *C12N 15/1138* (2013.01); *C12N 2310/11* (2013.01); *C12N 2310/315* (2013.01); *C12N 2310/321* (2013.01); *C12N 2310/3231* (2013.01); *C12N 2310/3341* (2013.01); *C12N 2310/346* (2013.01); *C12N 2310/351* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,751,219 A | 6/1988 | Kempen et al. |
| 4,845,205 A | 7/1989 | Huynh Dinh et al. |
| 4,981,957 A | 1/1991 | Lableu et al. |
| 5,034,506 A | 7/1991 | Summerton et al. |
| 5,118,800 A | 6/1992 | Smith |
| 5,130,302 A | 7/1992 | Spielvogel et al. |
| 5,134,066 A | 7/1992 | Rogers et al. |
| 5,166,315 A | 11/1992 | Summerton et al. |
| 5,175,273 A | 12/1992 | Bischofberger et al. |
| 5,185,444 A | 2/1993 | Summerton et al. |
| 5,319,080 A | 6/1994 | Leumann |
| 5,359,044 A | 10/1994 | Cook et al. |
| 5,366,878 A | 11/1994 | Pederson et al. |
| 5,367,066 A | 11/1994 | Urdea et al. |
| 5,393,878 A | 2/1995 | Leumann |
| 5,432,272 A | 7/1995 | Benner |
| 5,446,137 A | 8/1995 | Maag et al. |
| 5,457,187 A | 10/1995 | Gmelner et al. |
| 5,459,255 A | 10/1995 | Cook et al. |
| 5,466,786 A | 11/1995 | Buhr et al. |
| 5,484,908 A | 1/1996 | Froehler et al. |
| 5,502,177 A | 3/1996 | Matteucci et al. |
| 5,514,785 A | 5/1996 | Van Ness et al. |
| 5,519,134 A | 5/1996 | Acevedo et al. |
| 5,525,711 A | 6/1996 | Hawkins |
| 5,552,540 A | 9/1996 | Haralambidis |
| 5,567,811 A | 10/1996 | Mistura et al. |
| 5,576,427 A | 11/1996 | Cook et al. |
| 5,587,469 A | 12/1996 | Cook et al. |
| 5,591,722 A | 1/1997 | Montgomery et al. |
| 5,594,121 A | 1/1997 | Froehler et al. |
| 5,596,091 A | 1/1997 | Switzer |
| 5,597,909 A | 1/1997 | Urdea et al. |
| 5,610,300 A | 3/1997 | Altmann et al. |
| 5,614,617 A | 3/1997 | Cook et al. |
| 5,627,053 A | 5/1997 | Usman et al. |
| 5,639,873 A | 6/1997 | Barascut et al. |
| 5,645,985 A | 7/1997 | Frothier et al. |
| 5,646,265 A | 7/1997 | McGee |
| 5,670,633 A | 9/1997 | Cook et al. |
| 5,681,941 A | 10/1997 | Cook et al. |
| 5,698,685 A | 12/1997 | Summerton et al. |
| 5,700,920 A | 12/1997 | Altmann et al. |
| 5,750,692 A | 5/1998 | Cook et al. |
| 5,763,588 A | 6/1998 | Matteucci et al. |
| 5,792,847 A | 8/1998 | Buhr et al. |
| 5,801,154 A | 9/1998 | Baracchini et al. |
| 5,830,653 A | 11/1998 | Froehler et al. |
| 5,994,517 A | 11/1999 | Ts'o et al. |
| 6,005,096 A | 12/1999 | Matteucci et al. |

(Continued)

FOREIGN PATENT DOCUMENTS

WO   WO 1997/020563   6/1997
WO   WO 1997/046098   12/1997

(Continued)

OTHER PUBLICATIONS

GenBank Accession DQ756277 (2006).*

(Continued)

*Primary Examiner* — Richard A Schnizer
(74) *Attorney, Agent, or Firm* — Grant IP, Inc.

(57) ABSTRACT

The present embodiments provide methods, compounds, and compositions for treating, preventing, ameliorating a disease associated with excess growth hormone using antisense compounds oligonucleotides targeted to growth hormone receptor (GHR).

43 Claims, No Drawings

(56) References Cited

U.S. PATENT DOCUMENTS

| | | |
|---|---|---|
| 6,268,490 B1 | 7/2001 | Imanishi et al. |
| 6,300,319 B1 | 10/2001 | Manoharan |
| 6,383,812 B1 | 5/2002 | Chen et al. |
| 6,525,031 B2 | 2/2003 | Manoharan |
| 6,525,191 B1 | 2/2003 | Ramasamy |
| 6,582,908 B2 | 6/2003 | Fodor et al. |
| 6,600,032 B1 | 7/2003 | Manoharan et al. |
| 6,620,916 B1 | 9/2003 | Takahara et al. |
| 6,660,720 B2 | 12/2003 | Manoharan et al. |
| 6,670,461 B1 | 12/2003 | Wengel et al. |
| 6,673,661 B1 | 1/2004 | Liu |
| 6,770,748 B2 | 8/2004 | Imanishi et al. |
| 6,794,499 B2 | 9/2004 | Wengel et al. |
| 6,906,182 B2 | 6/2005 | Ts'o et al. |
| 6,908,903 B1 | 6/2005 | Theodore et al. |
| 7,034,133 B2 | 4/2006 | Wengel et al. |
| 7,053,207 B2 | 5/2006 | Wengel |
| 7,262,177 B2 | 8/2007 | Ts'o et al. |
| 7,399,845 B2 | 7/2008 | Seth et al. |
| 7,399,853 B2 | 7/2008 | Freier et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,563,884 B2 | 7/2009 | Cowsert et al. |
| 7,569,686 B1 | 8/2009 | Bhat et al. |
| 7,582,744 B2 | 9/2009 | Manoharan et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,142 B2 | 7/2010 | Freier |
| 7,851,615 B2 | 12/2010 | Manoharan et al. |
| 8,106,022 B2 | 1/2012 | Manoharan et al. |
| 8,137,695 B2 | 3/2012 | Rozema et al. |
| 8,158,601 B2 | 4/2012 | Chen et al. |
| 8,313,772 B2 | 11/2012 | Rozema et al. |
| 8,344,125 B2 | 1/2013 | Manoharan et al. |
| 8,349,308 B2 | 1/2013 | Yurkovetskiy et al. |
| 8,404,862 B2 | 3/2013 | Manoharan et al. |
| 8,435,491 B2 | 5/2013 | Wang |
| 8,450,467 B2 | 5/2013 | Manoharan et al. |
| 8,501,805 B2 | 8/2013 | Seth et al. |
| 8,501,930 B2 | 8/2013 | Rozema et al. |
| 8,541,548 B2 | 9/2013 | Rozema |
| 8,546,556 B2 | 10/2013 | Seth et al. |
| 8,552,163 B2 | 10/2013 | Lee et al. |
| 2001/0053519 A1 | 12/2001 | Fodor et al. |
| 2003/0077829 A1 | 4/2003 | MacLachlan |
| 2003/0119724 A1 | 6/2003 | Ts'o et al. |
| 2003/0228597 A1 | 12/2003 | Cowsert et al. |
| 2004/0146910 A1* | 7/2004 | Zhou .................. C12Q 1/6883 435/6.11 |
| 2004/0171570 A1 | 9/2004 | Allerson et al. |
| 2005/0112118 A1* | 5/2005 | Cimbora ............... C07K 14/47 424/143.1 |
| 2005/0130923 A1 | 6/2005 | Bhat et al. |
| 2005/0164235 A1 | 7/2005 | Manoharan et al. |
| 2006/0003322 A1 | 1/2006 | Bentwich |
| 2006/0148740 A1 | 7/2006 | Platenburg |
| 2006/0183886 A1 | 8/2006 | Tso et al. |
| 2007/0020679 A1* | 1/2007 | Ward .................. C07F 9/65586 435/6.16 |
| 2007/0031844 A1 | 2/2007 | Khvorova et al. |
| 2007/0243546 A1* | 10/2007 | Cao ..................... C12Q 1/6837 435/6.12 |
| 2007/0287831 A1 | 12/2007 | Seth et al. |
| 2008/0039618 A1 | 2/2008 | Allerson et al. |
| 2008/0108801 A1 | 5/2008 | Manoharan et al. |
| 2008/0206869 A1 | 8/2008 | Smith et al. |
| 2008/0281041 A1 | 11/2008 | Rozema et al. |
| 2008/0281044 A1 | 11/2008 | Manoharan et al. |
| 2009/0012281 A1 | 1/2009 | Swayze et al. |
| 2009/0203132 A1 | 8/2009 | Swayze et al. |
| 2009/0203135 A1 | 8/2009 | Forst et al. |
| 2009/0286973 A1 | 11/2009 | Manoharan et al. |
| 2010/0240730 A1 | 9/2010 | Beigelman et al. |
| 2010/0292140 A1 | 11/2010 | Bhanot et al. |
| 2011/0092572 A1 | 4/2011 | Tachas et al. |
| 2011/0097264 A1 | 4/2011 | Wang et al. |
| 2011/0097265 A1 | 4/2011 | Wang et al. |
| 2011/0191912 A1 | 4/2011 | Alexandrov et al. |
| 2011/0123520 A1 | 5/2011 | Manoharan et al. |
| 2011/0178283 A1 | 7/2011 | Rigoutsos et al. |
| 2011/0207799 A1 | 8/2011 | Rozema et al. |
| 2011/0269814 A1 | 11/2011 | Manoharan et al. |
| 2012/0035115 A1 | 2/2012 | Manoharan et al. |
| 2012/0084885 A1 | 4/2012 | Alexandrov et al. |
| 2012/0095075 A1 | 4/2012 | Manoharan et al. |
| 2012/0101148 A1 | 4/2012 | Aking et al. |
| 2012/0128760 A1 | 5/2012 | Manoharan et al. |
| 2012/0136042 A1 | 5/2012 | Manoharan et al. |
| 2012/0157509 A1 | 6/2012 | Hadwiger et al. |
| 2012/0165393 A1 | 6/2012 | Rozema et al. |
| 2012/0230938 A1 | 9/2012 | Rozema et al. |
| 2012/0277284 A1 | 11/2012 | Swayze et al. |
| 2013/0004427 A1 | 1/2013 | El-Sayed et al. |
| 2013/0053431 A1 | 2/2013 | Tachas et al. |
| 2013/0059902 A1 | 3/2013 | Corey et al. |
| 2013/0109817 A1 | 5/2013 | Yurkovetskiy et al. |
| 2013/0121954 A1 | 5/2013 | Wakefield |
| 2013/0178512 A1 | 7/2013 | Manoharan et al. |
| 2013/0203836 A1* | 8/2013 | Rajeev ................. C07H 19/067 514/44 A |
| 2013/0236968 A1 | 9/2013 | Manoharan et al. |
| 2013/0281511 A1* | 10/2013 | Bettencourt ......... A61K 31/713 514/44 A |
| 2017/0073689 A1 | 3/2017 | Bhanot et al. |

FOREIGN PATENT DOCUMENTS

| | | |
|---|---|---|
| WO | WO 1998/013381 | 4/1998 |
| WO | WO 1998/39352 | 9/1998 |
| WO | WO 1999/014226 | 3/1999 |
| WO | WO 2000/063364 | 10/2000 |
| WO | WO 2001/023616 | 4/2001 |
| WO | WO 2001/049687 | 7/2001 |
| WO | WO 2001/053528 | 7/2001 |
| WO | WO 2001/077384 | 10/2001 |
| WO | WO 2002/010378 | 2/2002 |
| WO | WO 2002/043771 | 6/2002 |
| WO | WO 2002/092772 | 11/2002 |
| WO | WO 2003/004602 | 1/2003 |
| WO | WO 2004/035765 | 10/2003 |
| WO | WO 2004009541 | * 1/2004 |
| WO | WO 2004/011624 | 2/2004 |
| WO | WO 2004/024757 | 3/2004 |
| WO | WO 2004/063208 | 7/2004 |
| WO | WO 2004/071407 | 8/2004 |
| WO | WO 2004/078922 | 9/2004 |
| WO | WO 2004/096016 | 11/2004 |
| WO | WO 2004/096996 | 11/2004 |
| WO | WO 2004/101619 | 11/2004 |
| WO | WO 2004/106356 | 12/2004 |
| WO | WO 2005/021570 | 3/2005 |
| WO | WO 2005/065686 | 7/2005 |
| WO | WO 2005/071080 | 8/2005 |
| WO | WO 2005/121371 | 12/2005 |
| WO | WO 2006/044531 | 4/2006 |
| WO | WO 2006/047842 | 5/2006 |
| WO | WO 2007/035759 | 3/2007 |
| WO | WO 2007/035771 | 3/2007 |
| WO | WO 2007/090071 | 8/2007 |
| WO | WO 2007/131237 | 11/2007 |
| WO | WO 2007/134014 | 11/2007 |
| WO | WO 2007/134181 | 11/2007 |
| WO | WO 2007/136988 | 11/2007 |
| WO | WO 2008/098788 | 8/2008 |
| WO | WO 2008/101157 | 8/2008 |
| WO | WO 2008/150729 | 12/2008 |
| WO | WO 2008/154401 | 12/2008 |
| WO | WO 2009/003009 | 12/2008 |
| WO | WO 2009/006478 | 1/2009 |
| WO | WO 2009/046141 | 4/2009 |
| WO | WO 2009/061851 | 5/2009 |
| WO | WO 2009/067647 | 5/2009 |

(56) References Cited

FOREIGN PATENT DOCUMENTS

| | | |
|---|---|---|
| WO | WO 2009/073809 | 6/2009 |
| WO | WO 2009/082607 | 7/2009 |
| WO | WO 2009/100320 | 8/2009 |
| WO | WO 2009/126933 | 10/2009 |
| WO | WO 2009/134487 | 11/2009 |
| WO | WO 2009/143369 | 11/2009 |
| WO | WO 2010/036696 | 4/2010 |
| WO | WO 2010/036698 | 4/2010 |
| WO | WO 2010/045509 | 4/2010 |
| WO | WO 2010/054406 | 5/2010 |
| WO | WO 2010/077578 | 7/2010 |
| WO | WO 2010/088537 | 8/2010 |
| WO | WO 2010/121074 | 10/2010 |
| WO | WO 2010/129709 | 11/2010 |
| WO | WO 2010/144740 | 12/2010 |
| WO | WO 2010/148013 | 12/2010 |
| WO | WO 2011/008995 | 1/2011 |
| WO | WO 2011/017521 | 2/2011 |
| WO | WO 2011/038356 | 3/2011 |
| WO | WO 2011/100131 | 8/2011 |
| WO | WO 2011/115818 | 9/2011 |
| WO | WO 2011/120053 | 9/2011 |
| WO | WO 2011/139702 | 11/2011 |
| WO | WO 2011/163121 | 12/2011 |
| WO | WO 2012/037254 | 3/2012 |
| WO | WO 2012/068187 | 5/2012 |
| WO | WO 2012/083046 | 6/2012 |
| WO | WO 2012/083185 | 6/2012 |
| WO | WO 2012/089352 | 7/2012 |
| WO | WO 2012/089602 | 7/2012 |
| WO | WO 2012/142458 | 10/2012 |
| WO | WO 2012/174476 | 12/2012 |
| WO | WO 2012/177947 | 12/2012 |
| WO | WO 2013/033230 * | 3/2013 |
| WO | WO 2013/043817 | 3/2013 |
| WO | WO 2013/063313 | 5/2013 |
| WO | WO 2013/075035 | 5/2013 |
| WO | WO 2013/119979 | 8/2013 |
| WO | WO 2013/155204 | 10/2013 |
| WO | WO 2013/165816 | 11/2013 |
| WO | WO 2013/166121 | 11/2013 |
| WO | WO 2013/173635 | 11/2013 |
| WO | WO 2013/173647 | 11/2013 |
| WO | WO 2014/076195 | 5/2014 |
| WO | WO 2014/076196 | 5/2014 |
| WO | WO 2014/118272 | 8/2014 |
| WO | WO 2014/179620 | 11/2014 |
| WO | WO 2014/179625 | 11/2014 |
| WO | WO 2014/179626 | 11/2014 |
| WO | WO 2014/179627 | 11/2014 |
| WO | WO 2014/179629 | 11/2014 |
| WO | WO 2014/205451 | 12/2014 |
| WO | WO 2014/207232 | 12/2014 |
| WO | WO 2015/002971 | 1/2015 |
| WO | WO 2015/042447 | 3/2015 |
| WO | WO 2015/071388 | 5/2015 |
| WO | WO 2015/168514 | 11/2015 |
| WO | WO 2015/168532 | 11/2015 |
| WO | WO 2015/168589 | 11/2015 |
| WO | WO 2015/168618 | 11/2015 |
| WO | WO 2015/168635 | 11/2015 |
| WO | WO 2015/179693 | 11/2015 |
| WO | WO 2015/188194 | 12/2015 |

OTHER PUBLICATIONS

GenBank DQ574391 (2008).*
Liu et al (Cancer Sci 99(10): 2055-2061, 2008) (Year: 2008).*
Adcock et al., "A Laboratory Approach to the Evaluation of Hereditary Hypercoagulability" American Journal of Clinical Pathology. (1997) 108:434-49.
Akinc et al., "Targeted delivery of RNAi Therapeutics with endogenous and exogenous ligand-based mechanisms," Molecular Therapy, (2010) 18: 1357-1364.
Allshire, "RNAi and Heterocturomatin—a Hushed-Up Affair" Science (2002) 297: 1818-1819.
Albaek et al., "Analogues of a Locked Nucleic Acid with Three-Carbon 2',4 -Linkages: Synthesis by Ring-Closing Metathesis and Influence of Nucleic Acid Duplex Stability" J. Org. Chem. (2006) 71:7731-7740.
Altmann et al., "Second Generation Antisense Oligonucleotides—Inhibition of PKC-α and c-raf Kinase Expression by Chimeric Oligonucleotides Incorporating 6"-Substituted Carbocyclic Nucleosides and 2"-O-Ethylene Glycol Substituted Ribonucleosides" Nuclewsodies Nucleotides. (1997) 16:917-926.
Altmann et al., "Second Generation of Antisense Oligonucleotides: From Nuclease Resistance to Biological Efficacy in Animals" Chimia. (1996) 50(4):168-176.
Altmann et al., "Second-generation antisense oligonucleotides: structure—activity relationships and the design of improved signal-transduction inhibitors" Biochem. Soc. Trans. (1996) 24:630-637.
Armstrong et al., "Localization of the Fibroblast Growth Factor Receptor-4 Gene to Chromasome Region 5q33-qter" Genes Chromosomes Cancer (1992) 4: 94-98.
Atsma et al., "Partial characterization of low density lipoprotein preparations isolated from fresh and frozen plasma after radiolabeling by seven different methods." J Lipid Res. Jan. 1991; 32(1): 173-181.
Baker et al., "2'-O-(2-Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" J. Biol. Chem. (1997) 272:11994-12000.
Bange et al., "Cancer progression and tumor cell motility are associated with the FGFR4 Arg(388) allele." Cancer Res. (2002) 62(3):840-847.
Baron et al., "Role of Hyperglucagonemia in Maintenance of Increased Rates of Hepatic Glucose Output in Type II Diabetics" Diabetes (1987) 36: 274-283.
Bennett, "Pharmacological Properties of 2'-O-Methoxyethyl Modified Oligonucleotides" in Antisense a Drug Technology, Chapter 10, Crooke, S.T., ed., 2008, pp. 273-303.
Bertina et al., "Mutation in blood coagulation factor V associated with resistance to activated protein C" Nature (1994) 369(6475):64-67.
Biessen et al., "Synthesis of Cluster Galactosides with High Affinity for the Hepatic Asialoglycoprotein Receptor" J. Med. Chem. (1995) 38:1538-1546.
Biessen et al., "The Cholesterol Derivative of a Triantennary Galactoside with High Affinity for the Hepatic Asialoglycoprotein Receptor: a Potent Cholesterol Lowering Agent" J. Med. Chem. (1995) 38:1846-1852.
Biessen et al., "Novel hepatotrophic prodrugs of the antiviral nucleoside 9-(2-phosphonylmethoxyethyl)adenine with improved pharmacokinetics and antiviral activity" FASEB J. (2000) 14: 1784-1792.
Bjork et al., "Mechanism of the anticoagulant action of heparin" Mol. Cell. Biocebm. (1982) 48(3):161-182.
Braasch et al., "Locked nucleic acid (LNA): fine-tuning the recognition of DNA and RNA" Chem. Biol. (2001) 8:1-7.
Braasch et al., "Novel Antisense and Peptide Nucleic Acid Strategies for Controlling Gene Expression" Biochemistry (2002) 41(14): 4503-4510.
Branda et al., "Amplification of antibody production by phosphorothioate oligodeoxynucleolides" J Lab Clin Med. (1996) 128(3): 329-38.
Brown-Shimer et al., "Effect of protein tyrosine phosphatase 1B expression on transformation by the human neu oncogene" Cancer Res. (1992) 52:478-482.
Brubaker et al., "Structure-Function of the Glucagon Receptor Family of G Protein—Coupled Receptors: The Glucagon, GIP, GLP-1, and GLP-2 Receptors" Recept. Channels. (2002) 8: 179-88.
Connolly et al., "Binding and Endocytosis of Cluster Glycosides by Rabbit Hepatocytes" J Biol Chem (1982) 257: 939-945.
Drake et al., "Selective cellular expression of tissue factor in human tissues. Implications for disorders of hemostasis and thrombosis" Am. J. Pathol. (1989) 134(5):1087-1097.

(56) References Cited

OTHER PUBLICATIONS

Duff et al., "Intrabody Tissue-Specific Delivery of Antisense Conjugates in Animals: Ligand-Linker-Antisense Oligomer Conjugates" Methods in Enzymology (1999) 313. 297-321.
Dupouy et al., "Watson-Crick Base-Pairing Properties of Nucleic Acid Analogues with Stereocontrolled a and b Torsion Angles (a,b-D-CNAs)" Angew. Chem. Int. Ed. (2006)45: 3623-3627.
Elayadi et al., "Application of PNA and LNA oligomers to chemotherapy" Curr. Opinion Invens. Drugs (2001) 2:558-561.
Elchebly et al., "Increased Insulin Sensitivity and Obesity Resistance in Mice Lacking the Protein Tyrosine Phosphatase-1B Gene" Science (1999) 283: 1544-1548.
Englisch et al., "Chemically Modified Oligonucleotides as Probes and Inhibitors" Agnew Chem. Int. Ed. Engl. (1991) 30:613-629.
Freier et al., "The ups and downs of nucleic acid duplex stability: structure-stability studies on chemically-modified DNA:RNA duplexes" Nucleic Acids Research (1997) 25(22):4429-4443.
Frieden et al., "Expanding the design horizon of antisense oligonucleotides with alpha-L-LNA" Nucleic Acids Research (2003) 31(21):6365-6372.
Gautschi et al. "Activity of a Novel bcl-2/bcl-xL-Bispecific Antisense Oligonucleotide Against Tumors of Diverse Histologic Origins" J. Natl. Cancer Inst. (2001) 93:463-471.
Geary et al., "Effect of Dose and Plasma Concentration on Liver Uptake and Pharmacologic Activity of a 2'-Methoxyethyl Modified Chimeric Antisense Oligonucleotide Targeting PTEN." Biochem. Pharmacol. (2009) 78(3): 284-291.
Geary et al., "Pharmacokinetic Properties of 2'-O-(2-Methoxyethyl)-Modified Oligonucleotide Analogs in Rats" The Journal of Pharmacology and Experimental Therapeutics (2001) 296:890-897.
GenBank entry NM_000163.3 (2011): http://www.ncbi.nlm.nih.gov/nuccore/334883125.
Goldstein et al., "Tyrosine dephosphorylation and deactivation of insulin receptor substrate-1 by protein-tyrosine phosphatase 1B. Possible facilitation by the formation of a ternary complex with the Grb2 adaptor protein." J. Biol. Chem. (2000) 275(6): 4283-4289.
Gu et al., "Base pairing properties of D- and L-cyclohexene nucleic acids (CeNA)" Oligonucleotides (2003) 13(6):479-489.
Gu et al., "Enzymatic resolution and base pairing properties of D- and L-cyclohexenyl nucleic acids (CeNA)" Nucleosides Nucleotides Nucleic Acids (2005) 24 (5-7):993-998.
Gu et al., "Synthesis of enantiomeric-pure cyclohexenyl nucleoside building blocks for oligonucleotide synthesis" Tetrahedron (2004) 60(9):2111-2123.
Guzaev et al., "A conformationally preorganized universal solid support for efficient oligonucleotide synthesis" J. Am. Chem. Soc. (2003) 125(9):2380-2381.
Hall et al., "Establishment and maintenance of a heterochromatin domain" Science (2002) 297(5590):2232-2237.
Hanessian et al., "Synthesis of chemically and functionally diverse scaffolds from pentaerythritol" Canadian Journal of Chemistry (1996) 74(9):1731-1737.
Hansen et al., "glucagon Receptor mRNA Distribution in Rat Tissues" Peptides (1995) 16: 1163-1166.
Henkel et al., "Impact of glucagon response on postprandial hyperglycemia in men with impaired glucose tolerance and type 2 diabetes mellitus." Metabolism (2005) 54: 1168-1173.
Horn et al., "Chemical synthesis and characterization of branched oligodeoxyribonucleotides (bDNA) for use as signal amplifiers in nucleic acid quantification assays." Nucleic Acids Research (1997) 25: 4842-4849.
Holtrich et al., "Two additional protein-tyrosine kinases expressed in human lung: fourth member of the fibroblast growth factor receptor family and an intracellular protein-tyrosine kinase." PNAS (1991) 88(23):10411-10415.
Horvath et al., "Stereoselective synthesis of (-)-ara-cyclohexenyl-adenine" Tetrahedron Letters (2007) 48:3621-3623.
Huang et al., "FGFR4 prevents hyperlipidemia and insulin resistance but underlies high-fat diet induced fatty liver." Diabetes (2007) 56(10): 2501-2510.
Jayaprakash et al., "Non-Nucleoside Building Blocks for Copper-Assisted and Copper-Free Click Chemistry for the Efficient Synthesis of RNA Conjugates" Organic Letters (2010) 12(23): 5410-5413.
Jenuwein, "Molecular biology. An RNA-guided pathway for the epigenome" Science (2002) 297(5590):2215-2218.
Jiang et al., "Glucagon and regulation of glucose metabolism" Am. J. Physiol. Endocrinol. Metab. (2003) 284: E671-E678.
Jiang et al., "The Design and Synthesis of Highly Branched and Spherically Symmetric Fluorinated Oils and Amphiles." Tetrahedron (2007) 63(19): 3982-3988.
Jin et al.: "Use of α-N,N-bis[Carboxymethyl]lysine-Modified Peroxidase in Immunoassays" Analytical Biochemistry (1995) 229(1): 54-60.
Kato et al., "N-acetylgalactosamine incorporation into a peptide containing consecutive threonine residues by UDP-N-acetyl-D-galactosaminide:polypeptide N-acetylgalactosaminyltransferases" Glyobiology (2001) 11: 821-829.
Khorev et al., "Trivalent, Gal/GalNAc-containing ligands designed for the asialoglycoprotein receptor" Bioorganic & Medicinal Chemistry (2008) 16: 5216-5231.
Kim et al., "Oligomeric Glycopeptidomimetics Bearing the Cancer Related TN-Antigen" Tetrahedron Letters (1997) 38(20):3487-3490.
Kim et al., "Synthesis of Novel Phosphoramidite Building Blocks from Pentaerythritol" Synlett (2003) 12:1838-1840.
Klaman et al., "Increased Energy Expenditure, Decreased Adiposity, and Tissue-Specific Insulin Sensitivity in Protein-Tyrosine Phosphatase 1B-Deficient Mice" Mol. Cell. Biol. (2000) 20(15): 5479-5489.
Koller et al., "Mechanisms of single-stranded phosphorothioate modified antisense oligonucleotide accumulation in hepatocytes." Nucleic Acids Res. (2011) 39(11): 4795-4807.
Kornilova et al., "Development of a fluorescence polarization binding assay for asialoglycoprotein receptor" Analytical Biochemistry (2012) 425: 43-46.
Koshkin et al., "LNA (locked nucleic acids): Synthesis of the adenine, cytosine, guanine, 5-methylcytosine, thymine and uracil bicyclonucleoside monomers, oligomerisalion, and unprecedented nucleic acid recognition" Tetrahedron (1998) 54:3607-3630.
Kroschwitz, The Concise Encyclopedia of Polymer Science and Engineering, J.I., Ed., John Wiley & Sons, 1990, 858-859.
Kumar et at, "The first analogues of LNA (locked nucleic acids): phosphorothioate-LNA and 2'-thio-LNA" Bioorg Med Chem Lett. (1998) 8:2219-2222.
Lamontagne et al., "Protein tyrosine phosphatase PTP1B suppresses p210 bcr-abl-induced transformation of rat-1 fibroblasts and promotes differentiation of K562 cells" Proc. Natl. Acad. Sci. USA (1998)95:14094-14099.
Lee et al., "New and more efficient multivalent glyco-ligands for asialoglycoprotein receptor of mammalian hepatocytes" Bioorganic & Medicinal Chemistry (2011) 19:2494-2500.
Lee et al., "New synthetic cluster ligands for galactose/N-acetylgalactosamine-specific lectin of mammalian liver" Biochem (1984) 23: 4255-4261.
Lee et al., "Facile Synthesis of a High-Affinity Ligand for Mammalian Hepatic Lectin Containing Three Terminal N-Acetylgalactosamine Residues" Bioconjugate Chem. (1997) 8: 762-765.
Lee et al., "Protein micmarrays to study carbohydrate-recognition events" Bioorg Med Chem Lett (2006) 16(19): 5132-5135.
Lee et al., "Preparation of Cluster Glycosides of Nacetylgalactosamine That Have Subnanomolar Binding Constants Towards the Mammalian Hepatic Gal/GalNAc-specific Receptor" Glycoconjugate J. (1987) 4: 317-328.
Lee et al., "Synthesis of multivalent neoglycoconjugates of MUC1 by the conjugation of carbohydrate-centered, triazole-linked glycoclusters to MUC1 peptides using click chemistry." J Org Chem (2012) 77: 7564-7571.

(56) References Cited

OTHER PUBLICATIONS

Lee et al., "Reversible inactivation of protein-tyrosine phosphatase 1B in A431 cells stimulated with epidermal growth factor" *J. Biol. Chem.* (1998) 273:15366-15372.

Lee et al., "Synthesis of Peptide-Based Trivalent Scaffold for Preparation of Cluster Glycosides" Methods in Enzymology (2003)362: 38-43.

Lee et al., "Synthesis of some cluster glycosides suitable for attachment to proteins or solid matrices" Carbohydrate Research (1978) 67: 509-514.

Leumann et al., "DNA Analogues: From Supramolecular Principles to Biological Properties" Bioorganic & Medicinal Chemistry (2002) 10:841-854.

Liu et al., "Protein tyrosine phosphatase 1B interacts with and is tyrosine phosphorylated by the epidermal growth factor receptor" Biochem. J. (1997) 327:139-145.

Liu et al., "Transformation suppression by protein tyrosine phosphatase 1B requires a functional SH3 ligand" *Mol. Cell. Biol.* (1998) 18:250-259.

Maher et al., "Comparative hybrid arrest by tandem antisense oligodeoxyribonucleotides or oligodeoxyribonucleoside methylphosphonates in a cell-free system" Nuc. Acid. Res. (1988) 16(8):3341-3358.

Maier et al., "Synthesis of Antisense Oligonucleotides Conjugated to a Multivalent Carbohydrate Cluster for Cellular Targeting" Bioconjugate Chem. (2003) 14: 18-29.

Maierhofer et al., "Probing multivalent carbohydrate-lectin interactions by an enzyme-linked lectin assay employing covalently immobilized carbohydrates" Bioorganic & Medicinal Chemistry (2007) 15: 7661-7676.

Manoharan, "Oligonucleotide Conjugates as Potential Antisense Drugs with Improved Uptake, Biodistribution Targeted Delivery, and Mechanism of Action" Antisense & Nucleic Acid Drug Development (2002) 12: 103-128.

Martin, "New acces to 2'-O-alkylated ribonucleosides and properties of 2'-O-alkylated oligoribonucleotides" Helv. Chim. Acta. (1995) 78:486-504.

Merwin et al., "Targeted delivery of DNA using YEE(GalNAcAH)3, a synthetic glycopeptide ligand for the asialoglycoprotein receptor." Bioconjug Chem (1994) 5(6): 612-620.

Nauwelaerts et al., "Cyclohexenyl nucleic acids: conformationally flexible oligonucleotides" Nucleic Acids Res. (2005) 33(8):2452-2463.

Nauwelaerts et al., "Structural characterization and biological evaluation of small interfering RNAs containing cyclohexenyl nucleosides" J. Am. Chem. Soc. (2007) 129(30):9340-9348.

Nawano et al., "Hyperglycemia contributes insulin resistance in hepatic and adipose tissue but not skeletal muscle of ZDF rats." Am. J. Physiol. Endocrinol. Metab. (2000) 278(3):E535-543.

Neel et al., "Protein tyrosine phosphatases in signal transduction." Curr. Opin. Cell Biol. (1997) 9(2): 193-204.

Opherk et al., "Inactivation of the Glucocorticoid Receptor in Hepatocytes Leads to Fasting Hypoglycemia and Ameliorates Hyperglycemia in Streptozotocin-Induced Diabetes Mellitus" Mol. Endocrinol. (2004) 18:1346-1353.

Orum et al., "Locked nucleic acids: A promising molecular family for gene-function analysis and antisense drug development" Curr. Opinion Mol. Ther. (2001) 3:239-243.

Pal-Bhadra et al., "Heterochromatic silencing and HP1 localization in *Drosophila* are dependent on the RNAi machinery" Science (2004) 303(5658):669-672.

Park et al., "The asialoglycoprotein receptor clears glycoconjugates terminating with sialic acid a2,6GalNAc" PNAS (2005) 102(47): 17125-17129.

Patel et al., "Essential role of fibroblast growth factor signaling in preadipoctye differentiation."J Clin Endocrinol Metab. (2005) 90(2):1226-1232.

Pavia et al., "Synthetic TN glycopeptide related to human glycophorin AM. High-field proton and carbon-13 nuclear magnetic resonance study." Int J Pep Protein Res (1983) 22: 539-548.

Petrova et al., "Carrier-free cellular uptake and the gene-silencing of the lipophilic siRNAs is strongly affected by the length of the linker between siRNA and lipophilic group" Nucleic Acids Research (2012) 40(5): 2330-2344; abstract p. 2333.

Pujol et al., "A Sulfur Tripod GlycocoMugate that Releases a High-Affinity Copper Chelator in Hepatocytes" Angew. Chem. Int. Ed. (2012) 51: 7445-7448.

Quesada et al., "Physiology of the pancreatic a-cell and glucagon secretion: role in glucose homeostasis and diabetes" J. Endocrinol. (2008) 199: 5-19.

Rajur et al., "Covalent Protein-Oligonucleotide Conjugates for Efficient Delivery of Antisense Molecules" Bioconjugate Chem. (1997) 8: 935-940.

Rensen et al., "Design and Synthesis of Novel N-Acetylgalactosamine-Terminated Glycolipids for Targeting of Lipoproteins to the Hepatic Asialoglycoprotein Receptor" J. Med. Chem. (2004) 47:5798-5808.

Rensen et al., "Determination of the Upper Size Limit for Uptake and Processing of Ligands by the Asialoglycoprotein Receptor on Hepatocytes in Vitro and in Vivo" J. Biol. Chem. (2001) 276(40):37577-37584.

Rensen et al., "Stimulation of Liver-Directed Cholesterol Flux in Mice by Novel N-Acetylgalactosamine-Terminated Glycolipids With High Affinity for the Asialoglycoprotein Receptor" Arterioscler Thromb Vasc Biol (2006) 26: 169-175.

Robeyns et al., "Oligonucleotides with cyclohexene-nucleoside building blocks: crystallization and preliminary X-ray studies of a left-handed sequence GTGTACAC" Acta. Crystallogr. Sect. F. Struct. Biol. Cryst. Commun. (2005) 61(Pt 6):585-586.

Robeyns et al., "Structure of the fully modified left-handed cyclohexene nucleic acid sequence GTGTACAC" J. Am. Chem. Soc. (2008) 130(6):1979-1984.

Rouchaud et al., "A New and Efficient Synthesis od Derivatives of Octahydro-4H-pyrrolo-[1,2-c]pyrido[1',2'-a]imidazole" Eur. J. Org. Chem. (2011) 12: 2346-2353.

Sanghvi et al., "Heterocyclic Base Modifications in Nucleic Acids and Their Applications in Antisense Oligonucleotides" Antisense Research and Applications, Chapter 15 (1993) pp. 273-288.

Sato et al., "Glycoinsulins: Dendrite Sialyloligosaccharide-Displaying Insulins Showing a Prolonged Blood-Sugar-Lowering Activity" J. Am. Chem. Soc. (2004) 126: 14013-14022.

Schwartz et al., "Tissue factor pathway inhibitor endocytosis" Trends Cardiovasc. Med. (1997) 7(7):234-239.

Seth et al., "Synthesis and biophysical characterization of R-6'-Me-α-L-LNA modified oligonucleotides." Bioorg. Med. Chem. (2011) 21(4): 1122-1125.

Seth et al., "Synthesis and Biophysical Evaluation of 2',4'-Constrained 2'O-Methoxyethyl and 2',4'-Constrained 2'O-Ethyl Nucleic Acid Analogues" J Org Chem. (2010) 75(5): 1569-1581.

Seth et al., "Design, Synthesis and Evaluation of Constrained Methoxyetbyl (cMOE) and Constrained Ethyl (cEt) Nucleoside Analogs" Nucleic Acids Symposium Series (2008) 52(1): 553-554.

Shah et al., "Impact of lack of suppression of glucagon on glucose tolerance in humans" Am. J. Phsiol. Endocrinol. Metab. (1999) 277:E283-E290.

Shah et al., "Lack of suppression of glucagon contributes to postprandial hyperglycemia in subjects with type 2 diabetes mellitus." J. Clin. Endocrinol. Meab. (2000) 85(11):4053-4059.

Shchepinov et al., "Oligonucleotide dendrimers: synthesis and use as polylabelled DNA probes." Nucleic Acids Research (1997) 25(22): 4447-4454.

Shchepinov et al., "Oligonucleotide dendrimers: stable nano-structures" Nucleic Acids Research (1999) 27(15): 3035-3041.

Sindelka et al., "Association of obesity, diabetes, serum lipids and blood pressure regulates insulin action" Physiol. Res. (2002) 51(1):85-91.

Singh et al., "LNA (locked nucleic acids): synthesis and high-affinity nucleic acid recognition" Chem. Commun. (1998) 455-456.

(56) References Cited

OTHER PUBLICATIONS

Singh et al., "Synthesis of 2'-amino-LNA: A novel conformationally restricted high-affinity oligonucleotide analogue with a handle" J. Org. Chem. (1998) 63: 10035-10039.
Sliedregt et al., "Design and Synthesis of Novel Amphiphilic Dendritic Galactosides for Selective Targeting of Liposomes to the Hepatic Asialoglycoprotein Receptor" J. Med. Chem. (1999) 42:609-618.
Srivastava et al., "Five- and Six-Membered Conformationally Locked 2',4'-Carbocyclic ribo-Thymidines: Synthesis, Structure, and Biochemical Studies" J. Am. Chem. Soc. (2007) 129(26):8362-8379.
Tober et al., "Self-Metathesis of Polyol Allyl Ethers towards Carbohydrate-Based Oligohydroxy Derivatives" Eur. J. Org. Chem. (2013) 3: 566-577.
Tomiya et al., "Liver-targeting of primaquine-(poly-c-glutamic acid) and its degradation in rat hepatocytes" Bioorganic & Medicinal Chemistry (2013) 21: 5275-5281.
Crooke et al., "Toxicologic Properties of 2-O-Methoxyethyl Chimeric Antisense Inhibitors in Animals and Man" in Antisense a Drug Technology, Chapter 12, pp. 342-351, Crooke, S.T., ed., 2008.
Toyokuni et al., "Synthetic vaccines: I. Synthesis of multivalent Tn antigen cluster-lysyllysine conjugates" Tetrahedron Lett (1990) 31(19): 2673-2676.
Valentijn et al., "Solid-phase Synthesis of Lysine-based Cluster Galactosides with High Affinity for the Asialoglycoprotein Receptor" Tetrahedron (1997) 53(2): 759-770.
Van Rossenberg et al., "Stable polyplexes based on arginine-containing oligopeptides for in vivo gene delivery" Gene Ther (2004) 11: 457-464.
Verbeure et al., "RNase H mediated cleavage of RNA by cyclohexene nucleic acid (CeNA)" Nucleic Acids Res. (2001) 29(24):4941-4947.
Verdel et al., "RNAi-mediated targeting of heterochromatin by the RITS complex" Science (2004) 303(5668):672-676.
Volpe et al., "Regulation of heterochromatic silencing and histone H3 lysine-9 methylation by RNAi" Science (2002) 297(5588):1833:1837.
Wahlestedt et al., "Potent and nontoxic antisense oligonucleotide containing locked nucleic acids" Proc. Natl. Acad. Sci. USA (2000) 97: 5633-5638.
Wang et al., "Cyclohexene nucleic acids (CeNA) form stable duplexes with RNA and induce RNase H activity" Nucleosides Nucleotides Nucleic Acids (2001) 20(4-7):785-788.
Wang et al., "A straightforward stereoselective synthesis of D- and L-5-hydroxy-4-hydroxymethyl-2-cyclohexenylguanine" J. Org. Chem. (2001) 66(25):8478-8482.
Wang et al., "Stereocontrolled synthesis of ara-type cyclohexenyl nucleosides" J. Org. Chem. (2003) 68(11):4499-4505.
Wang et al., "Cyclohexene Nucleic Acids (CeNA): Serum Stable Oligonucleotides that Activate RNase H and Increase Duplex Stability with Complementary RNA" J. Am. Chem. Soc. (2000) 122(36):8595-8602.
Weber et al., "Design and synthesis of P2-P1'-linked macrocyclic human renin inhibitors" J. Med. Chem. (1991) 34(9): 2692-2701.
Westerlind et al., "Ligands of the asialoglycoprotein receptor for targeted gene delivery, part 1: Synthesis of and binding studies with biotinylated cluster glycosides containing N-acetylgalactosamine" Glycoconjugate Journal (2004) 21: 227-241.
Wiener et al., "Overexpression of the tyrosine phosphatase PTP1B is associated with human ovarian carcinomas" Am. J. Obstet. Gynecol. (1994) 170:1177-1183.
Woolf et al. "Specificity of antisense oligonucleotides in vivo" PNAS (1992)89:7305-7309.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J. Org. Chem. (2009)74:118-134.
European Search report for application 14791863.5 dated Dec. 2, 2016.

International Search Report for application PCT/US15/28887 dated Oct. 28, 2015.
International Search Report for application PCT/US14/36466 dated Dec. 1, 2014.
Altschul et al., "Basic Local Alignment Search Tool" J. Mol. Biol. (1990) 215:403-410.
Branch et al., "A good antisense molecule is hard to find," TIBS (1998) 23:45-50.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Crooke et al., "Basic Principles of Antisense Therapeutics" Antisense Research and Application (1998) Chapter 1:1-50.
Crooke et al., "Pharmacokinetic Properties of Several Novel Oligonucleotide Analogs in mice" J. Pharmacol. Exp. Ther. (1996) 277(2):923-937.
Wilkinson-Berka et al., "An antisense oligonucleotide targeting the growth hormone receptor inhibits neovascularization in a mouse model of retinopathy" Molecular Vision 2007 13:1529-1538.
Zhang et al., "PowerBLAST: A New Network BLAST Application for Interactive or Automated Sequence Analysis and Annotation" Genome Res. (1997) 7:649-656.
Kabanov et al., "A new class of antivirals: antisense oligonucleotides combined with a hydrophobic substituent effectively inhibit influenza virus reproduction and synthesis of virus-specific proteins in MDCK cells" FEBS Lett. (1990) 259:327-330.
Letsinger et al., "Cholesteryl-conjugated oligonucleotides: Synthesis, properties, and activity as inhibitors of replication of human immunodeficiency virus in cell culture" PNAS (1989) 86:6553-6556.
Manoharan et al., "Chemical Modifications to Improve Uptake and Bioavailability of Antisense Oligonucleotides" Ann. N.Y. Acad. Sci. (1992) 660: 306-309.
Manoharan et al., "Cholic Acid-Oligonucleotide Conjugates for Antisense Applications" Bioorg. Med. Chem. Lett. (1994) 4:1053-1060.
Manoharan et al., "Introduction of a Lipophilic Thioether Tether in the Minor Groove of Nucleic Acids for Antisense Applications" Bioorg. Med. Chem. Lett. (1993) 3(12):2765-2770.
Manoharan et al., "Lipidic Nucleic Acids" Tetrahedron Lett. (1995) 36(21):3651-3654.
Manoharan et al., "Oligonucleotide Conjugates: Alteration of the Pharmacokinetic Properties of Antisense Agents" Nucleosides & Nucleotides (1995) 14(3-5):969-973.
Mishra et al., "Improved leishmanicidal effect of phosphorotioate antisense oligonucleotides by LDL-mediated delivery" Biochim. Biophys. Acta (1995) 1264:229-237.
New England Biolabs 1998/99 Catalog (cover page and pp. 121 and 284).
Oberhauser et al., "Effective incorporation of 2'-O-methyl-oligoribonucleotides into liposomes and enhanced cell association through modifications with thiocholesterol" Nucl. Acids Res. (1992) 20(3):533-538.
Pelligrini et al., "Central Administration of a growth hormone (GH) receptor mRNA antisense increases GH pulsatility and decreases hypothalamic somatosatin expression in rats," Neuroscience (1996) 16: 8140-8148.
Ran et al, "Effect of rhGH on JAK2-STAT3 signal pathway after GHR was down-regulated by siRNA in gastric cancer cell" Acta Pharmaceutica Sinica 2013 48(3):435-440. (Abstract Only).
Reynolds et al., "Rational siRNA design for RNA interference" Nature Biotechnology (2004) 22(3):326-330.
Saison-Behmoaras et al., "Short modified antisense oligonucleotides directed against Ha-ras point mutation induce selective cleavage of the mRNA and inhibit T24 cells proliferation" EMBO J. (1991) 10(5):1111-1118.
Sanghvi et al., Antisense Research and Applications, CRC Press, Boca Ratou, 1993, pp. 276-278.

(56) References Cited

OTHER PUBLICATIONS

Scherer et al., "Approaches for the sequence-specific knockdown of mRNA" Nature Biotechnology (2003) 21(12):1457-1465.

Shea et al., "Synthesis, hybridization properties and antiviral activity of lipid-oligodeoxynucleotide conjugates" Nucl. Acids Res. (1990) 18(13):3777-3783.

Simon et al., "Recognition of 2'-O-methylated 3'-end of piRNA by the PAZ domain of a Piwi protein," Structure (2011) 19: 172-180.

Smith et al., "Comparison of biosequences" Adv. Appl. Math. (1981) 2(4):482-489.

Svinarchuk et al., "Inhibition of HIV proliferation in MT-4 cells by antisense oligonucleotide conjugated to lipophilic groups" Biochimie (1993) 75:49-54.

Tachas et al., "A GH receptor antisense oligonucleotide inhibits hepatic GH receptor expression, IGF-I production and body weight gain in normal mice," Journal of Endocrinology (2006) 189: 147-154.

Vickers et al. "Efficient reduction of target RNAs by small interfering RNA and Rnase H-dependent antisense agents: A comparative analysis" J Biol Chem (2003) 278(9):7108-7118.

GenBank Accession DQ572139 (2006).

European Search Report Application No. 14819490.5 dated Feb. 3, 2017.

European Search Report Application No. 14819490.5 dated May 12, 2017.

Supplementary Partial European Search Report dated Nov. 8, 2017 in European Patent Application No. EP 15786107.1, filed on May 1, 2015 and published as EP 3 137 604 on Mar. 8, 2017.

Sanghvi "Carbohydrate Modifications in Antisense Research" Sanghvi and Cook, eds., (1994) ACS Symposium Series 580, Chapters 3, 4, pp. 40-65.

GenBank Accession No. DQ574391, "Homo sapiens piRNA piR-42503, complete sequence" Dec. 2, 2008.

Rajeev, "Conjugation Strategies for In Vitro siRNA Delivery" 8th Annual Meeting of the Oligonucleotide Therapeutics Society (2012).

\* cited by examiner

US 9,994,855 B2

COMPOSITIONS AND METHODS FOR MODULATING GROWTH HORMONE RECEPTOR EXPRESSION

SEQUENCE LISTING

The present application is being filed along with a Sequence Listing in electronic format. The Sequence Listing is provided as a file entitled BIOL0253USASEQ 25 1-19-18 created Jan. 19, 2018, which is 1,353,485 bytes in size. The information in the electronic format of the sequence listing is incorporated herein by reference in its entirety.

FIELD

The present embodiments provide methods, compounds, and compositions for treating, preventing, or ameliorating a disease associated with excess growth hormone using antisense compounds or oligonucleotides targeted to growth hormone receptor (GHR).

BACKGROUND

Growth hormone is produced in the pituitary and secreted into the bloodstream where it binds to growth hormone receptor (GHR) on many cell types, causing production of insulin-like growth factor-1 (IGF-1). IGF-1 is produced mainly in the liver, but also in adipose tissue and the kidney, and secreted into the bloodstream. Several disorders, such as acromegaly and gigantism, are associated with elevated growth hormone levels and/or elevated IGF-I levels in plasma and/or tissues.

Excessive production of growth hormone can lead to diseases such as acromegaly or gigantism. Acromegaly and gigantism are associated with excess growth hormone, often caused by a pituitary tumor, and affects 40-50 per million people worldwide with about 15,000 patients in each of the US and Europe and an annual incidence of about 4-5 per million people. Acromegaly and gigantism are initially characterized by abnormal growth of the hands and feet and bony changes in the facial features. Many of the growth related outcomes are mediated by elevated levels of serum IGF-1.

SUMMARY

Embodiments provided herein relate to methods, compounds, and compositions for treating, preventing, or ameliorating a disease associated with excess growth hormone. Several embodiments provided herein are drawn to antisense compounds or oligonucleotides targeted to growth hormone receptor (GHR). Several embodiments are directed to treatment, prevention, or amelioration of acromegaly with antisense compounds or oligonucleotides targeted to growth hormone receptor (GHR).

DETAILED DESCRIPTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference for the portions of the document discussed herein, as well as in their entirety.

Unless specific definitions are provided, the nomenclature used in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Certain such techniques and procedures may be found for example in "Carbohydrate Modifications in Antisense Research" Edited by Sangvi and Cook, American Chemical Society, Washington D.C., 1994; "Remington's Pharmaceutical Sciences," Mack Publishing Co., Easton, Pa., $21^{st}$ edition, 2005; and "Antisense Drug Technology, Principles, Strategies, and Applications" Edited by Stanley T. Crooke, CRC Press, Boca Raton, Fla.; and Sambrook et al., "Molecular Cloning, A laboratory Manual," $2^{nd}$ Edition, Cold Spring Harbor Laboratory Press, 1989, which are hereby incorporated by reference for any purpose. Where permitted, all patents, applications, published applications and other publications and other data referred to throughout in the disclosure are incorporated by reference herein in their entirety.

Unless otherwise indicated, the following terms have the following meanings:

"2'-F nucleoside" refers to a nucleoside comprising a sugar comprising fluorine at the 2' position. Unless otherwise indicated, the fluorine in a 2'-F nucleoside is in the ribo position (replacing the OH of a natural ribose).

"2'-O-methoxyethyl" (also 2'-MOE and 2'-O($CH_2$)$_2$—$OCH_3$) refers to an O-methoxyethyl modification at the 2' position of a furanose ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" means a nucleoside comprising a substituent at the 2'-position other than H or OH. Unless otherwise indicated, a 2'-substituted nucleoside is not a bicyclic nucleoside.

"2'-substituted sugar moiety" means a furanosyl comprising a substituent at the 2'-position other than H or OH. Unless otherwise indicated, a 2'-substituted sugar moiety is not a bicyclic sugar moiety (i.e., the 2'-substituent of a 2'-substituted sugar moiety does not form a bridge to another atom of the furanosyl ring.

"3' target site" refers to the nucleotide of a target nucleic acid which is complementary to the 3'-most nucleotide of a particular antisense compound.

"5' target site" refers to the nucleotide of a target nucleic acid which is complementary to the 5'-most nucleotide of a particular antisense compound.

"5-methylcytosine" means a cytosine modified with a methyl group attached to the 5 position. A 5-methylcytosine is a modified nucleobase.

"About" means within ±10% of a value. For example, if it is stated, "the compounds affected at least about 70% inhibition of GHR", it is implied that GHR levels are inhibited within a range of 60% and 80%.

"Administration" or "administering" refers to routes of introducing an antisense compound provided herein to a subject to perform its intended function. An example of a route of administration that can be used includes, but is not limited to parenteral administration, such as subcutaneous, intravenous, or intramuscular injection or infusion.

"Alkyl," as used herein, means a saturated straight or branched hydrocarbon radical containing up to twenty four carbon atoms. Examples of alkyl groups include without limitation, methyl, ethyl, propyl, butyl, isopropyl, n-hexyl, octyl, decyl, dodecyl and the like. Alkyl groups typically include from 1 to about 24 carbon atoms, more typically from 1 to about 12 carbon atoms ($C_1$-$C_{12}$alkyl) with from 1 to about 6 carbon atoms being more preferred.

As used herein, "alkenyl," means a straight or branched hydrocarbon chain radical containing up to twenty four carbon atoms and having at least one carbon-carbon double bond. Examples of alkenyl groups include without limitation, ethenyl, propenyl, butenyl, 1-methyl-2-buten-1-yl, dienes such as 1,3-butadiene and the like. Alkenyl groups typically include from 2 to about 24 carbon atoms, more typically from 2 to about 12 carbon atoms with from 2 to about 6 carbon atoms being more preferred. Alkenyl groups as used herein may optionally include one or more further substituent groups.

As used herein, "alkynyl," means a straight or branched hydrocarbon radical containing up to twenty four carbon atoms and having at least one carbon-carbon triple bond. Examples of alkynyl groups include, without limitation, ethynyl, 1-propynyl, 1-butynyl, and the like. Alkynyl groups typically include from 2 to about 24 carbon atoms, more typically from 2 to about 12 carbon atoms with from 2 to about 6 carbon atoms being more preferred. Alkynyl groups as used herein may optionally include one or more further substituent groups.

As used herein, "acyl," means a radical formed by removal of a hydroxyl group from an organic acid and has the general Formula —C(O)—X where X is typically aliphatic, alicyclic or aromatic. Examples include aliphatic carbonyls, aromatic carbonyls, aliphatic sulfonyls, aromatic sulfinyls, aliphatic sulfinyls, aromatic phosphates, aliphatic phosphates and the like. Acyl groups as used herein may optionally include further substituent groups.

As used herein, "alicyclic" means a cyclic ring system wherein the ring is aliphatic. The ring system can comprise one or more rings wherein at least one ring is aliphatic. Preferred alicyclics include rings having from about 5 to about 9 carbon atoms in the ring. Alicyclic as used herein may optionally include further substituent groups.

As used herein, "aliphatic" means a straight or branched hydrocarbon radical containing up to twenty four carbon atoms wherein the saturation between any two carbon atoms is a single, double or triple bond. An aliphatic group preferably contains from 1 to about 24 carbon atoms, more typically from 1 to about 12 carbon atoms with from 1 to about 6 carbon atoms being more preferred. The straight or branched chain of an aliphatic group may be interrupted with one or more heteroatoms that include nitrogen, oxygen, sulfur and phosphorus. Such aliphatic groups interrupted by heteroatoms include without limitation, polyalkoxys, such as polyalkylene glycols, polyamines, and polyimines Aliphatic groups as used herein may optionally include further substituent groups.

As used herein, "alkoxy" means a radical formed between an alkyl group and an oxygen atom wherein the oxygen atom is used to attach the alkoxy group to a parent molecule. Examples of alkoxy groups include without limitation, methoxy, ethoxy, propoxy, isopropoxy, n-butoxy, sec-butoxy, tert-butoxy, n-pentoxy, neopentoxy, n-hexoxy and the like. Alkoxy groups as used herein may optionally include further substituent groups.

As used herein, "aminoalkyl" means an amino substituted $C_1$-$C_{12}$ alkyl radical. The alkyl portion of the radical forms a covalent bond with a parent molecule. The amino group can be located at any position and the aminoalkyl group can be substituted with a further substituent group at the alkyl and/or amino portions.

As used herein, "aralkyl" and "arylalkyl" mean an aromatic group that is covalently linked to a $C_1$-$C_{12}$ alkyl radical. The alkyl radical portion of the resulting aralkyl (or arylalkyl) group forms a covalent bond with a parent molecule. Examples include without limitation, benzyl, phenethyl and the like. Aralkyl groups as used herein may optionally include further substituent groups attached to the alkyl, the aryl or both groups that form the radical group.

As used herein, "aryl" and "aromatic" mean a mono- or polycyclic carbocyclic ring system radicals having one or more aromatic rings. Examples of aryl groups include without limitation, phenyl, naphthyl, tetrahydronaphthyl, indanyl, idenyl and the like. Preferred aryl ring systems have from about 5 to about 20 carbon atoms in one or more rings. Aryl groups as used herein may optionally include further substituent groups.

"Amelioration" refers to a lessening of at least one indicator, sign, or symptom of an associated disease, disorder, or condition. In certain embodiments, amelioration includes a delay or slowing in the progression of one or more indicators of a condition or disease. The severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid.

"Antisense compound" means an oligomeric compound that is capable of undergoing hybridization to a target nucleic acid through hydrogen bonding. Examples of antisense compounds include single-stranded and double-stranded compounds, such as, antisense oligonucleotides, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means a single-stranded oligonucleotide having a nucleobase sequence that permits hybridization to a corresponding region or segment of a target nucleic acid.

"Base complementarity" refers to the capacity for the precise base pairing of nucleobases of an antisense oligonucleotide with corresponding nucleobases in a target nucleic acid (i.e., hybridization), and is mediated by Watson-Crick, Hoogsteen or reversed Hoogsteen hydrogen binding between corresponding nucleobases.

"Bicyclic sugar moiety" means a modified sugar moiety comprising a 4 to 7 membered ring (including but not limited to a furanosyl) comprising a bridge connecting two atoms of the 4 to 7 membered ring to form a second ring, resulting in a bicyclic structure. In certain embodiments, the 4 to 7 membered ring is a sugar ring. In certain embodiments the 4 to 7 membered ring is a furanosyl. In certain such embodiments, the bridge connects the 2'-carbon and the 4'-carbon of the furanosyl.

"Bicyclic nucleic acid" or "BNA" or "BNA nucleosides" means a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring.

"Cap structure" or "terminal cap moiety" means chemical modifications, which have been incorporated at either terminus of an antisense compound.

"Carbohydrate" means a naturally occurring carbohydrate, a modified carbohydrate, or a carbohydrate derivative.

"Carbohydrate cluster" means a compound having one or more carbohydrate residues attached to a scaffold or linker group. (see, e.g., Maier et al., "Synthesis of Antisense Oligonucleotides Conjugated to a Multivalent Carbohydrate Cluster for Cellular Targeting," *Bioconjugate Chemistry*, 2003, (14): 18-29, which is incorporated herein by reference in its entirety, or Rensen et al., "Design and Synthesis of Novel N-Acetylgalactosamine-Terminated Glycolipids for Targeting of Lipoproteins to the Hepatic Asiaglycoprotein Receptor," *J. Med. Chem.* 2004, (47): 5798-5808, for examples of carbohydrate conjugate clusters).

"Carbohydrate derivative" means any compound which may be synthesized using a carbohydrate as a starting material or intermediate.

"cEt" or "constrained ethyl" means a bicyclic sugar moiety comprising a bridge connecting the 4'-carbon and the 2'-carbon, wherein the bridge has the formula: 4'-CH(CH$_3$)—O-2'.

"Constrained ethyl nucleoside" (also cEt nucleoside) means a nucleoside comprising a bicyclic sugar moiety comprising a 4'-CH(CH$_3$)—O-2' bridge.

"Chemically distinct region" refers to a region of an antisense compound that is in some way chemically different than another region of the same antisense compound. For example, a region having 2'-O-methoxyethyl nucleotides is chemically distinct from a region having nucleotides without 2'-O-methoxyethyl modifications.

"Chemical modification" means a chemical difference in a compound when compared to a naturally occurring counterpart. Chemical modifications of oligonucleotides include nucleoside modifications (including sugar moiety modifications and nucleobase modifications) and internucleoside linkage modifications. In reference to an oligonucleotide, chemical modification does not include differences only in nucleobase sequence.

"Chimeric antisense compounds" means antisense compounds that have at least 2 chemically distinct regions, each position having a plurality of subunits.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group that is capable of being split under physiological conditions. In certain embodiments, a cleavable moiety is cleaved inside a cell or sub-cellular compartments, such as a lysosome. In certain embodiments, a cleavable moiety is cleaved by endogenous enzymes, such as nucleases. In certain embodiments, a cleavable moiety comprises a group of atoms having one, two, three, four, or more than four cleavable bonds.

"Co-administration" means administration of two or more pharmaceutical agents to an individual. The two or more pharmaceutical agents may be in a single pharmaceutical composition, or may be in separate pharmaceutical compositions. Each of the two or more pharmaceutical agents may be administered through the same or different routes of administration. Co-administration encompasses parallel or sequential administration.

"Complementarity" means the capacity for pairing between nucleobases of a first nucleic acid and a second nucleic acid.

"Comprise," "comprises" and "comprising" will be understood to imply the inclusion of a stated step or element or group of steps or elements but not the exclusion of any other step or element or group of steps or elements.

"Conjugate" or "conjugate group" means an atom or group of atoms bound to an oligonucleotide or oligomeric compound. In general, conjugate groups modify one or more properties of the compound to which they are attached, including, but not limited to pharmacodynamic, pharmacokinetic, binding, absorption, cellular distribution, cellular uptake, charge, and/or clearance properties.

"Conjugate linker" or "linker" in the context of a conjugate group means a portion of a conjugate group comprising any atom or group of atoms and which covalently link (1) an oligonucleotide to another portion of the conjugate group or (2) two or more portions of the conjugate group.

Conjugate groups are shown herein as radicals, providing a bond for forming covalent attachment to an oligomeric compound such as an antisense oligonucleotide. In certain embodiments, the point of attachment on the oligomeric compound is the 3'-oxygen atom of the 3'-hydroxyl group of the 3' terminal nucleoside of the oligomeric compound. In certain embodiments the point of attachment on the oligomeric compound is the 5'-oxygen atom of the 5'-hydroxyl group of the 5' terminal nucleoside of the oligomeric compound. In certain embodiments, the bond for forming attachment to the oligomeric compound is a cleavable bond. In certain such embodiments, such cleavable bond constitutes all or part of a cleavable moiety.

In certain embodiments, conjugate groups comprise a cleavable moiety (e.g., a cleavable bond or cleavable nucleoside) and a carbohydrate cluster portion, such as a GalNAc cluster portion. Such carbohydrate cluster portion comprises: a targeting moiety and, optionally, a conjugate linker. In certain embodiments, the carbohydrate cluster portion is identified by the number and identity of the ligand. For example, in certain embodiments, the carbohydrate cluster portion comprises 3 GalNAc groups and is designated "GalNAc$_3$". In certain embodiments, the carbohydrate cluster portion comprises 4 GalNAc groups and is designated "GalNAc$_4$". Specific carbohydrate cluster portions (having specific tether, branching and conjugate linker groups) are described herein and designated by Roman numeral followed by subscript "a". Accordingly "GalNAc3-1$_a$" refers to a specific carbohydrate cluster portion of a conjugate group having 3 GalNAc groups and specifically identified tether, branching and linking groups. Such carbohydrate cluster fragment is attached to an oligomeric compound via a cleavable moiety, such as a cleavable bond or cleavable nucleoside.

"Conjugate compound" means any atoms, group of atoms, or group of linked atoms suitable for use as a conjugate group. In certain embodiments, conjugate compounds may possess or impart one or more properties, including, but not limited to pharmacodynamic, pharmacokinetic, binding, absorption, cellular distribution, cellular uptake, charge and/or clearance properties.

"Contiguous nucleobases" means nucleobases immediately adjacent to each other.

"Constrained ethyl nucleoside" or "cEt" means a nucleoside comprising a bicyclic sugar moiety comprising a 4'-CH($CH_3$)—O-2'bridge.

"Deoxynucleoside" means a nucleoside comprising 2'-H furanosyl sugar moiety, as found in naturally occurring deoxyribonucleosides (DNA). In certain embodiments, a 2'-deoxynucleoside may comprise a modified nucleobase or may comprise an RNA nucleobase (e.g., uracil).

"Designing" or "Designed to" refer to the process of designing an oligomeric compound that specifically hybridizes with a selected nucleic acid molecule.

"Differently modified" mean chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

"Diluent" means an ingredient in a composition that lacks pharmacological activity, but is pharmaceutically necessary or desirable. For example, in drugs that are injected, the diluent may be liquid, e.g. saline solution.

"Dose" means a specified quantity of a pharmaceutical agent provided in a single administration, or in a specified time period. In certain embodiments, a dose may be administered in one, two, or more boluses, tablets, or injections. For example, in certain embodiments, where subcutaneous administration is desired, the desired dose requires a volume not easily accommodated by a single injection, therefore, two or more injections may be used to achieve the desired dose. In certain embodiments, the pharmaceutical agent is administered by infusion over an extended period of time or continuously. Doses may be stated as the amount of pharmaceutical agent per hour, day, week, or month.

"Double-stranded" refers to two separate oligomeric compounds that are hybridized to one another. Such double stranded compounds may have one or more or non-hybridizing nucleosides at one or both ends of one or both strands (overhangs) and/or one or more internal non-hybridizing nucleosides (mismatches) provided there is sufficient complementarity to maintain hybridization under physiologically relevant conditions.

"Downstream" refers to the relative direction towards the 3' end or C-terminal end of a nucleic acid.

"Effective amount" means the amount of active pharmaceutical agent sufficient to effectuate a desired physiological outcome in an individual in need of the agent. The effective amount may vary among individuals depending on the health and physical condition of the individual to be treated, the taxonomic group of the individuals to be treated, the formulation of the composition, assessment of the individual's medical condition, and other relevant factors.

"Effective amount" in the context of modulating an activity or of treating or preventing a condition means the administration of that amount of pharmaceutical agent to a subject in need of such modulation, treatment, or prophylaxis, either in a single dose or as part of a series, that is effective for modulation of that effect, or for treatment or prophylaxis or improvement of that condition. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Essentially unchanged" means little or no change in a particular parameter, particularly relative to another parameter which changes much more. In certain embodiments, a parameter is essentially unchanged when it changes less than 5%. In certain embodiments, a parameter is essentially unchanged if it changes less than two-fold while another parameter changes at least ten-fold. For example, in certain embodiments, an antisense activity is a change in the amount of a target nucleic acid. In certain such embodiments, the amount of a non-target nucleic acid is essentially unchanged if it changes much less than the target nucleic acid does, but the change need not be zero.

"Expression" means the process by which a gene ultimately results in a protein. Expression includes, but is not limited to, transcription, post-transcriptional modification (e.g., splicing, polyadenlyation, addition of 5'-cap), and translation.

"Fully complementary" or "100% complementary" means each nucleobase of a first nucleic acid has a complementary nucleobase in a second nucleic acid. In certain embodiments, a first nucleic acid is an antisense compound and a target nucleic acid is a second nucleic acid.

"Furanosyl" means a structure comprising a 5-membered ring comprising four carbon atoms and one oxygen atom.

"Gapmer" means a chimeric antisense compound in which an internal region having a plurality of nucleosides that support RNase H cleavage is positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Growth Hormone Receptor (GHR)" means any nucleic acid or protein of GHR. "GHR nucleic acid" means any nucleic acid encoding GHR. For example, in certain embodiments, a GHR nucleic acid includes a DNA sequence encoding GHR, an RNA sequence transcribed from DNA encoding GHR (including genomic DNA comprising introns and exons), including a non-protein encoding (i.e. non-coding) RNA sequence, and an mRNA sequence encoding GHR. "GHR mRNA" means an mRNA encoding a GHR protein.

"GHR specific inhibitor" refers to any agent capable of specifically inhibiting GHR RNA and/or GHR protein expression or activity at the molecular level. For example, GHR specific inhibitors include nucleic acids (including antisense compounds), peptides, antibodies, small molecules, and other agents capable of inhibiting the expression of GHR RNA and/or GHR protein.

"Halo" and "halogen," mean an atom selected from fluorine, chlorine, bromine and iodine.

"Heteroaryl," and "heteroaromatic," mean a radical comprising a mono- or poly-cyclic aromatic ring, ring system or fused ring system wherein at least one of the rings is aromatic and includes one or more heteroatoms. Heteroaryl is also meant to include fused ring systems including systems where one or more of the fused rings contain no heteroatoms. Heteroaryl groups typically include one ring atom selected from sulfur, nitrogen or oxygen. Examples of heteroaryl groups include without limitation, pyridinyl, pyrazinyl, pyrimidinyl, pyrrolyl, pyrazolyl, imidazolyl, thiazolyl, oxazolyl, isooxazolyl, thiadiazolyl, oxadiazolyl, thiophenyl, furanyl, quinolinyl, isoquinolinyl, benzimidazolyl, benzooxazolyl, quinoxalinyl and the like. Heteroaryl radicals can be attached to a parent molecule directly or through a linking moiety such as an aliphatic group or hetero atom. Heteroaryl groups as used herein may optionally include further substituent groups.

"Hybridization" means the annealing of complementary nucleic acid molecules. In certain embodiments, complementary nucleic acid molecules include, but are not limited to, an antisense compound and a nucleic acid target. In certain embodiments, complementary nucleic acid molecules include, but are not limited to, an antisense oligonucleotide and a nucleic acid target.

"Identifying an animal having, or at risk for having, a disease, disorder and/or condition" means identifying an animal having been diagnosed with the disease, disorder and/or condition or identifying an animal predisposed to develop the disease, disorder and/or condition. Such identification may be accomplished by any method including evaluating an individual's medical history and standard clinical tests or assessments.

"Immediately adjacent" means there are no intervening elements between the immediately adjacent elements.

"Individual" means a human or non-human animal selected for treatment or therapy.

"Inhibiting the expression or activity" refers to a reduction, blockade of the expression or activity and does not necessarily indicate a total elimination of expression or activity.

"Internucleoside linkage" refers to the chemical bond between nucleosides.

"Internucleoside neutral linking group" means a neutral linking group that directly links two nucleosides.

"Internucleoside phosphorus linking group" means a phosphorus linking group that directly links two nucleosides.

"Lengthened" antisense oligonucleotides are those that have one or more additional nucleosides relative to an antisense oligonucleotide disclosed herein.

"Linkage motif" means a pattern of linkage modifications in an oligonucleotide or region thereof. The nucleosides of such an oligonucleotide may be modified or unmodified. Unless otherwise indicated, motifs herein describing only linkages are intended to be linkage motifs. Thus, in such instances, the nucleosides are not limited.

"Linked deoxynucleoside" means a nucleic acid base (A, G, C, T, U) substituted by deoxyribose linked by a phosphate ester to form a nucleotide.

"Linked nucleosides" means adjacent nucleosides linked together by an internucleoside linkage.

"Locked nucleic acid nucleoside" or "LNA" "Locked nucleic acid" or "LNA" or "LNA nucleosides" means nucleic acid monomers having a bridge connecting two carbon atoms between the 4' and 2'position of the nucleoside sugar unit, thereby forming a bicyclic sugar. Examples of such bicyclic sugar include, but are not limited to A) α-L-Methyleneoxy (4'-CH$_2$—O-2') LNA, (B) β-D-Methyleneoxy (4'-CH$_2$—O-2') LNA, (C) Ethyleneoxy (4'-(CH$_2$)$_2$—O-2') LNA, (D) Aminooxy (4'-CH$_2$—O—N(R)-2') LNA and (E) Oxyamino (4'-CH$_2$—N(R)—O-2') LNA, as depicted below.

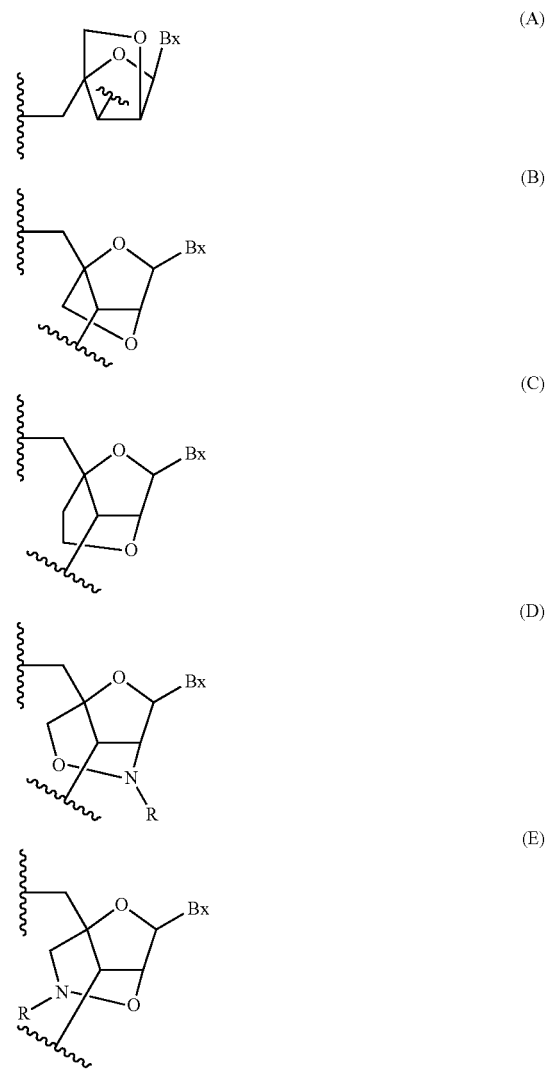

As used herein, LNA compounds include, but are not limited to, compounds having at least one bridge between the 4' and the 2' position of the sugar wherein each of the bridges independently comprises 1 or from 2 to 4 linked groups independently selected from —[C(R$_1$)(R$_2$)]$_n$—, —C(R$_1$)=C(R$_2$)—, —C(R$_1$)=N—, —C(=NR$_1$)—, —C(=O)—, —C(=S)—, —O—, —Si(R$_1$)$_2$—, —S(=O)$_x$— and —N(R$_1$)—; wherein: x is 0, 1, or 2; n is 1, 2, 3, or 4; each R$_1$ and R$_2$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, a heterocycle radical, a substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

Examples of 4'-2' bridging groups encompassed within the definition of LNA include, but are not limited to one of formulae: —[C(R$_1$)(R$_2$)]$_n$—, —[C(R$_1$)(R$_2$)]$_n$—O—, —C(R$_1$R$_2$)—N(R$_1$)—O— or —C(R$_1$R$_2$)—O—N(R$_1$)—. Furthermore, other bridging groups encompassed with the definition of LNA are 4'-CH$_2$-2',4'-(CH$_2$)$_2$-2',4'-(CH$_2$)$_3$-2', 4'-CH$_2$—O-2',4'-(CH$_2$)$_2$—O-2',4'-CH$_2$—O—N(R$_1$)-2' and 4'-CH$_2$—N(R$_1$)—O-2'- bridges, wherein each R$_1$ and R$_2$ is, independently, H, a protecting group or C$_1$-C$_{12}$ alkyl.

Also included within the definition of LNA according to the invention are LNAs in which the 2'-hydroxyl group of the ribosyl sugar ring is connected to the 4' carbon atom of the sugar ring, thereby forming a methyleneoxy (4'-CH$_2$—O-2') bridge to form the bicyclic sugar moiety. The bridge can also be a methylene (—CH$_2$—) group connecting the 2' oxygen atom and the 4' carbon atom, for which the term methyleneoxy (4'-CH$_2$—O-2') LNA is used. Furthermore; in the case of the bicyclic sugar moiety having an ethylene bridging group in this position, the term ethyleneoxy (4'-CH$_2$CH$_2$—O-2') LNA is used. α-L-methyleneoxy (4'-CH$_2$—O-2'), an isomer of methyleneoxy (4'-CH$_2$—O-2') LNA is also encompassed within the definition of LNA, as used herein.

"Metabolic disorder" means a disease or condition principally characterized by dysregulation of metabolism—the complex set of chemical reactions associated with breakdown of food to produce energy.

"Mismatch" or "non-complementary nucleobase" refers to the case when a nucleobase of a first nucleic acid is not capable of pairing with the corresponding nucleobase of a second or target nucleic acid.

"Modified carbohydrate" means any carbohydrate having one or more chemical modifications relative to naturally occurring carbohydrates.

"Modified internucleoside linkage" refers to a substitution or any change from a naturally occurring internucleoside bond (i.e. a phosphodiester internucleoside bond).

"Modified nucleobase" means any nucleobase other than adenine, cytosine, guanine, thymidine, or uracil. An "unmodified nucleobase" means the purine bases adenine (A) and guanine (G), and the pyrimidine bases thymine (T), cytosine (C) and uracil (U).

"Modified nucleoside" means a nucleoside having, independently, a modified sugar moiety and/or modified nucleobase.

"Modified nucleotide" means a nucleotide having, independently, a modified sugar moiety, modified internucleoside linkage, or modified nucleobase.

"Modified oligonucleotide" means an oligonucleotide comprising at least one modified internucleoside linkage, a modified sugar, and/or a modified nucleobase.

"Modified sugar" means substitution and/or any change from a natural sugar moiety. "Modified sugar moiety" means a substituted sugar moiety or a sugar surrogate.

"Modulating" refers to changing or adjusting a feature in a cell, tissue, organ or organism. For example, modulating GHR mRNA can mean to increase or decrease the level of GHR mRNA and/or GHR protein in a cell, tissue, organ or organism. A "modulator" effects the change in the cell, tissue, organ or organism. For example, a GHR antisense compound can be a modulator that decreases the amount of GHR mRNA and/or GHR protein in a cell, tissue, organ or organism.

"MOE" means —OCH$_2$CH$_2$OCH$_3$.

"Monomer" refers to a single unit of an oligomer. Monomers include, but are not limited to, nucleosides and nucleotides, whether naturally occurring or modified.

"Mono or polycyclic ring system" is meant to include all ring systems selected from single or polycyclic radical ring systems wherein the rings are fused or linked and is meant to be inclusive of single and mixed ring systems individually selected from aliphatic, alicyclic, aryl, heteroaryl, aralkyl, arylalkyl, heterocyclic, heteroaryl, heteroaromatic and heteroarylalkyl. Such mono and poly cyclic structures can contain rings that each have the same level of saturation or each, independently, have varying degrees of saturation including fully saturated, partially saturated or fully unsaturated. Each ring can comprise ring atoms selected from C, N, O and S to give rise to heterocyclic rings as well as rings comprising only C ring atoms which can be present in a mixed motif such as for example benzimidazole wherein one ring has only carbon ring atoms and the fused ring has two nitrogen atoms. The mono or polycyclic ring system can be further substituted with substituent groups such as for example phthalimide which has two =O groups attached to one of the rings. Mono or polycyclic ring systems can be attached to parent molecules using various strategies such as directly through a ring atom, fused through multiple ring atoms, through a substituent group or through a bifunctional linking moiety.

"Motif" means the pattern of unmodified and modified nucleosides in an antisense compound.

"Natural sugar moiety" means a sugar moiety found in DNA (2'-H) or RNA (2'-OH). "Naturally occurring sugar moiety" means a ribofuranosyl as found in naturally occurring RNA or a deoxyribofuranosyl as found in naturally occurring DNA.

"Naturally occurring internucleoside linkage" means a 3' to 5' phosphodiester linkage.

"Neutral linking group" means a linking group that is not charged. Neutral linking groups include without limitation phosphotriesters, methylphosphonates, MMI (—CH$_2$—N(CH$_3$)—O—), amide-3 (—CH$_2$—C(=O)—N(H)—), amide-4 (—CH$_2$—N(H)—C(=O)—), formacetal (—O—CH$_2$—O—), and thioformacetal (—S—CH$_2$—O—). Further neutral linking groups include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook Eds. ACS Symposium Series 580; Chapters 3 and 4, (pp. 40-65)). Further neutral linking groups include nonionic linkages comprising mixed N, O, S and CH$_2$ component parts.

"Non-complementary nucleobase" refers to a pair of nucleobases that do not form hydrogen bonds with one another or otherwise support hybridization.

"Non-internucleoside neutral linking group" means a neutral linking group that does not directly link two nucleosides. In certain embodiments, a non-internucleoside neutral linking group links a nucleoside to a group other than a nucleoside. In certain embodiments, a non-internucleoside neutral linking group links two groups, neither of which is a nucleoside.

"Non-internucleoside phosphorus linking group" means a phosphorus linking group that does not directly link two nucleosides. In certain embodiments, a non-internucleoside phosphorus linking group links a nucleoside to a group other than a nucleoside. In certain embodiments, a non-internucleoside phosphorus linking group links two groups, neither of which is a nucleoside.

"Nucleic acid" refers to molecules composed of monomeric nucleotides. A nucleic acid includes, but is not limited to, ribonucleic acids (RNA), deoxyribonucleic acids (DNA), single-stranded nucleic acids, and double-stranded nucleic acids.

"Nucleobase" means a heterocyclic moiety capable of pairing with a base of another nucleic acid.

"Nucleobase complementarity" or "complementarity" when in reference to nucleobases means a nucleobase that is capable of base pairing with another nucleobase. For example, in DNA, adenine (A) is complementary to thymine (T). For example, in RNA, adenine (A) is complementary to uracil (U). In certain embodiments, complementary nucleobase means a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair. Nucleobases comprising certain modifications may maintain the ability to pair with a counterpart nucleobase and thus, are still capable of nucleobase complementarity.

"Nucleobase modification motif" means a pattern of modifications to nucleobases along an oligonucleotide. Unless otherwise indicated, a nucleobase modification motif is independent of the nucleobase sequence.

"Nucleobase sequence" means the order of contiguous nucleobases independent of any sugar, linkage, and/or nucleobase modification.

"Nucleoside" means a compound comprising a nucleobase moiety and a sugar moiety. Nucleosides include, but are not limited to, naturally occurring nucleosides (as found in DNA and RNA) and modified nucleosides. Nucleosides may be linked to a phosphate moiety.

"Nucleoside mimetic" includes those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo or tricyclo sugar mimetics, e.g., non furanose sugar units. Nucleotide mimetic includes those structures used to replace the nucleoside and the linkage at one or more positions of an oligomeric compound such as for example peptide nucleic acids or morpholinos (morpholinos linked by —N(H)—C(=O)—O— or other non-phosphodiester linkage). Sugar surrogate overlaps with the slightly broader term nucleoside mimetic but is intended to indicate replacement of the sugar unit (furanose ring) only. The tetrahydropyranyl rings provided herein are illustrative of an example of a sugar surrogate wherein the furanose sugar group has been replaced with a tetrahydropyranyl ring system. "Mimetic" refers to groups that are substituted for a sugar, a nucleobase, and/or internucleoside linkage. Generally, a mimetic is used in place of the sugar or sugar-internucleoside linkage combination, and the nucleobase is maintained for hybridization to a selected target.

"Nucleoside motif" means a pattern of nucleoside modifications in an oligonucleotide or a region thereof. The linkages of such an oligonucleotide may be modified or unmodified. Unless otherwise indicated, motifs herein describing only nucleosides are intended to be nucleoside motifs. Thus, in such instances, the linkages are not limited.

"Nucleotide" means a nucleoside having a phosphate group covalently linked to the sugar portion of the nucleoside.

"Off-target effect" refers to an unwanted or deleterious biological effect associated with modulation of RNA or protein expression of a gene other than the intended target nucleic acid.

"Oligomeric compound" means a polymeric structure comprising two or more sub-structures. In certain embodiments, an oligomeric compound comprises an oligonucleotide. In certain embodiments, an oligomeric compound comprises one or more conjugate groups and/or terminal groups. In certain embodiments, an oligomeric compound consists of an oligonucleotide. Oligomeric compounds also include naturally occurring nucleic acids. In certain embodiments, an oligomeric compound comprises a backbone of one or more linked monomeric subunits where each linked monomeric subunit is directly or indirectly attached to a heterocyclic base moiety. In certain embodiments, oligomeric compounds may also include monomeric subunits that are not linked to a heterocyclic base moiety, thereby providing abasic sites. In certain embodiments, the linkages joining the monomeric subunits, the sugar moieties or surrogates and the heterocyclic base moieties can be independently modified. In certain embodiments, the linkage-sugar unit, which may or may not include a heterocyclic base, may be substituted with a mimetic such as the monomers in peptide nucleic acids.

"Oligonucleoside" means an oligonucleotide in which the internucleoside linkages do not contain a phosphorus atom.

"Oligonucleotide" means a polymer of linked nucleosides each of which can be modified or unmodified, independent one from another.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration.

"Peptide" means a molecular formed by linking at least two amino acids by amide bonds. Without limitation, as used herein, peptide refers to polypeptides and proteins.

"Pharmaceutical agent" means a substance that provides a therapeutic benefit when administered to an individual. For example, in certain embodiments, a conjugated antisense oligonucleotide targeted to GHR is a pharmaceutical agent.

"Pharmaceutical composition" means a mixture of substances suitable for administering to an individual. For example, a pharmaceutical composition may comprise one or more active pharmaceutical agents and a sterile aqueous solution.

"Pharmaceutically acceptable salts" means physiologically and pharmaceutically acceptable salts of antisense compounds, i.e., salts that retain the desired biological activity of the parent oligonucleotide and do not impart undesired toxicological effects thereto.

"Phosphorus linking group" means a linking group comprising a phosphorus atom. Phosphorus linking groups include without limitation groups having the formula:

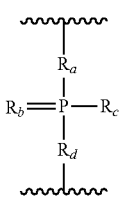

wherein:

$R_a$ and $R_d$ are each, independently, O, S, $CH_2$, NH, or $NJ_1$ wherein $J_1$ is $C_1$-$C_6$ alkyl or substituted $C_1$-$C_6$ alkyl;

$R_b$ is O or S;

$R_c$ is OH, SH, $C_1$-$C_6$ alkyl, substituted $C_1$-$C_6$ alkyl, $C_1$-$C_6$ alkoxy, substituted $C_1$-$C_6$ alkoxy, amino or substituted amino; and $J_1$ is $R_b$ is O or S.

Phosphorus linking groups include without limitation, phosphodiester, phosphorothioate, phosphorodithioate, phosphonate, phosphoramidate, phosphorothioamidate, thionoalkylphosphonate, phosphotriesters, thionoalkylphosphotriester and boranophosphate.

"Phosphorothioate linkage" means a linkage between nucleosides where the phosphodiester bond is modified by replacing one of the non-bridging oxygen atoms with a sulfur atom. A phosphorothioate linkage is a modified internucleoside linkage.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an antisense compound "Prevent" refers to delaying or forestalling the onset, development or progression of a disease, disorder, or condition for a period of time from minutes to indefinitely. Prevent also means reducing the risk of developing a disease, disorder, or condition.

"Prodrug" means an inactive or less active form of a compound which, when administered to a subject, is metabolized to form the active, or more active, compound (e.g., drug).

"Prophylactically effective amount" refers to an amount of a pharmaceutical agent that provides a prophylactic or preventative benefit to an animal.

"Protecting group" means any compound or protecting group known to those having skill in the art. Non-limiting examples of protecting groups may be found in "Protective Groups in Organic Chemistry", T. W. Greene, P. G. M. Wuts, ISBN 0-471-62301-6, John Wiley & Sons, Inc, New York, which is incorporated herein by reference in its entirety.

"Region" is defined as a portion of the target nucleic acid having at least one identifiable structure, function, or characteristic.

"Ribonucleotide" means a nucleotide having a hydroxy at the 2' position of the sugar portion of the nucleotide. Ribonucleotides may be modified with any of a variety of substituents.

"RISC based antisense compound" means an antisense compound wherein at least some of the antisense activity of the antisense compound is attributable to the RNA Induced Silencing Complex (RISC).

"RNase H based antisense compound" means an antisense compound wherein at least some of the antisense activity of the antisense compound is attributable to hybridization of the antisense compound to a target nucleic acid and subsequent cleavage of the target nucleic acid by RNase H.

"Salts" mean a physiologically and pharmaceutically acceptable salt of antisense compounds, i.e., salts that retain the desired biological activity of the parent oligonucleotide and do not impart undesired toxicological effects thereto.

"Segments" are defined as smaller or sub-portions of regions within a target nucleic acid.

"Separate regions" means portions of an oligonucleotide wherein the chemical modifications or the motif of chemical modifications of any neighboring portions include at least one difference to allow the separate regions to be distinguished from one another.

"Sequence motif" means a pattern of nucleobases arranged along an oligonucleotide or portion thereof. Unless otherwise indicated, a sequence motif is independent of chemical modifications and thus may have any combination of chemical modifications, including no chemical modifications.

"Side effects" means physiological disease and/or conditions attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Single-stranded" means an oligomeric compound that is not hybridized to its complement and which lacks sufficient self-complementarity to form a stable self-duplex.

"Sites," as used herein, are defined as unique nucleobase positions within a target nucleic acid.

"Slows progression" means decrease in the development of the said disease.

"Specifically hybridizable" refers to an antisense compound having a sufficient degree of complementarity between an antisense oligonucleotide and a target nucleic acid to induce a desired effect, while exhibiting minimal or no effects on non-target nucleic acids under conditions in which specific binding is desired, i.e., under physiological conditions in the case of in vivo assays and therapeutic treatments.

"Stringent hybridization conditions" or "stringent conditions" refer to conditions under which an oligomeric compound will hybridize to its target sequence, but to a minimal number of other sequences.

"Subject" means a human or non-human animal selected for treatment or therapy.

"Substituent" and "substituent group," means an atom or group that replaces the atom or group of a named parent compound. For example a substituent of a modified nucleoside is any atom or group that differs from the atom or group found in a naturally occurring nucleoside (e.g., a modified 2'-substituent is any atom or group at the 2'-position of a nucleoside other than H or OH). Substituent groups can be protected or unprotected. In certain embodiments, compounds of the present disclosure have substituents at one or at more than one position of the parent compound. Substituents may also be further substituted with other substituent groups and may be attached directly or via a linking group such as an alkyl or hydrocarbyl group to a parent compound.

Likewise, as used herein, "substituent" in reference to a chemical functional group means an atom or group of atoms that differs from the atom or a group of atoms normally present in the named functional group. In certain embodiments, a substituent replaces a hydrogen atom of the functional group (e.g., in certain embodiments, the substituent of a substituted methyl group is an atom or group other than hydrogen which replaces one of the hydrogen atoms of an unsubstituted methyl group). Unless otherwise indicated, groups amenable for use as substituents include without limitation, halogen, hydroxyl, alkyl, alkenyl, alkynyl, acyl (—C(O)$R_{aa}$), carboxyl (—C(O)O—$R_{aa}$), aliphatic groups, alicyclic groups, alkoxy, substituted oxy (—O—$R_{aa}$), aryl, aralkyl, heterocyclic radical, heteroaryl, heteroarylalkyl, amino (—N($R_{bb}$)($R_{cc}$)), imino(=N$R_{bb}$), amido (—C(O)N($R_{bb}$)($R_{cc}$) or —N($R_{bb}$)C(O)$R_{aa}$), azido (—$N_3$), nitro (—$NO_2$), cyano (—CN), carbamido (—OC(O)N($R_{bb}$)($R_{cc}$) or —N($R_{bb}$)C(O)O$R_{aa}$)), ureido (—N($R_{bb}$)C(O)N($R_{bb}$)($R_{cc}$)), thioureido (—N($R_{bb}$)C(S)N($R_{bb}$)—($R_{cc}$)), guanidinyl (—N($R_{bb}$)C(=N$R_{bb}$)N($R_{bb}$)($R_{cc}$)), amidinyl (—C(=N$R_{bb}$)N($R_{bb}$)($R_{cc}$) or —N($R_{bb}$)C(=N$R_{bb}$)($R_{aa}$)), thiol (—S$R_{bb}$), sulfinyl (—S(O)$R_{bb}$), sulfonyl (—S(O)$_2R_{bb}$) and sulfonamidyl (—S(O)$_2$N($R_{bb}$)($R_{cc}$) or —N($R_{bb}$)S(O)$_2R_{bb}$). Wherein each $R_{aa}$, $R_{bb}$ and $R_{cc}$ is, independently, H, an optionally linked chemical functional group or a further substituent group with a preferred list including without limitation, alkyl, alkenyl, alkynyl, aliphatic, alkoxy, acyl, aryl, aralkyl, heteroaryl, alicyclic, heterocyclic and heteroarylalkyl. Selected substituents within the compounds described herein are present to a recursive degree.

"Substituted sugar moiety" means a furanosyl that is not a naturally occurring sugar moiety. Substituted sugar moieties include, but are not limited to furanosyls comprising substituents at the 2'-position, the 3'-position, the 5'-position and/or the 4'-position. Certain substituted sugar moieties are bicyclic sugar moieties.

"Sugar moiety" means a naturally occurring sugar moiety or a modified sugar moiety of a nucleoside.

"Sugar motif" means a pattern of sugar modifications in an oligonucleotide or a region thereof.

"Sugar surrogate" means a structure that does not comprise a furanosyl and that is capable of replacing the naturally occurring sugar moiety of a nucleoside, such that the resulting nucleoside sub-units are capable of linking together and/or linking to other nucleosides to form an oligomeric compound which is capable of hybridizing to a complementary oligomeric compound. Such structures include rings comprising a different number of atoms than furanosyl (e.g., 4, 6, or 7-membered rings); replacement of the oxygen of a furanosyl with a non-oxygen atom (e.g., carbon, sulfur, or nitrogen); or both a change in the number of atoms and a replacement of the oxygen. Such structures may also comprise substitutions corresponding to those described for substituted sugar moieties (e.g., 6-membered carbocyclic bicyclic sugar surrogates optionally comprising additional substituents). Sugar surrogates also include more complex sugar replacements (e.g., the non-ring systems of peptide nucleic acid). Sugar surrogates include without limitation morpholinos, cyclohexenyls and cyclohexitols.

"Target" refers to a protein, the modulation of which is desired.

"Target gene" refers to a gene encoding a target.

"Targeting" or "targeted" means the process of design and selection of an antisense compound that will specifically hybridize to a target nucleic acid and induce a desired effect.

"Target nucleic acid," "target RNA," "target RNA transcript" and "nucleic acid target" all mean a nucleic acid capable of being targeted by antisense compounds. "Target nucleic acid" means a nucleic acid molecule to which an antisense compound is intended to hybridize to result in a desired antisense activity. Antisense oligonucleotides have sufficient complementarity to their target nucleic acids to allow hybridization under physiological conditions.

"Target region" means a portion of a target nucleic acid to which one or more antisense compounds is targeted.

"Target segment" means the sequence of nucleotides of a target nucleic acid to which an antisense compound is targeted. "5' target site" refers to the 5'-most nucleotide of a target segment. "3' target site" refers to the 3'-most nucleotide of a target segment.

"Terminal group" means one or more atom attached to either, or both, the 3' end or the 5' end of an oligonucleotide. In certain embodiments a terminal group is a conjugate group. In certain embodiments, a terminal group comprises one or more terminal group nucleosides.

"Terminal internucleoside linkage" means the linkage between the last two nucleosides of an oligonucleotide or defined region thereof.

"Therapeutically effective amount" means an amount of a pharmaceutical agent that provides a therapeutic benefit to an individual.

"The same type of modifications" refers to modifications that are the same as one another, including absence of modifications. Thus, for example, two unmodified DNA nucleosides have "the same type of modification," even though the DNA nucleoside is unmodified. Such nucleosides having the same type modification may comprise different nucleobases.

"Treat" refers to administering a pharmaceutical composition to an animal in order to effect an alteration or improvement of a disease, disorder, or condition in the animal. In certain embodiments, one or more pharmaceutical compositions can be administered to the animal.

"Type of modification" in reference to a nucleoside or a nucleoside of a "type" means the chemical modification of a nucleoside and includes modified and unmodified nucleosides. Accordingly, unless otherwise indicated, a "nucleoside having a modification of a first type" may be an unmodified nucleoside.

"Unmodified" nucleobases or "naturally occurring nucleobase" means the naturally occurring heterocyclic nucleobases of RNA or DNA: the purine bases adenine (A) and guanine (G), and the pyrimidine bases thymine (T), cytosine (C) (including 5-methyl C), and uracil (U).

"Unmodified nucleotide" means a nucleotide composed of naturally occurring nucleobases, sugar moieties, and internucleoside linkages. In certain embodiments, an unmodified nucleotide is an RNA nucleotide (i.e. β-D-ribonucleosides) or a DNA nucleotide (i.e. β-D-deoxyribonucleoside).

"Upstream" refers to the relative direction towards the 5' end or N-terminal end of a nucleic acid.

"Wing segment" means a plurality of nucleosides modified to impart to an oligonucleotide properties such as enhanced inhibitory activity, increased binding affinity for a target nucleic acid, or resistance to degradation by in vivo nucleases.

Certain Embodiments

Certain embodiments provide methods, compounds and compositions for inhibiting growth hormone receptor (GHR) expression.

Certain embodiments provide antisense compounds targeted to a GHR nucleic acid. In certain embodiments, the GHR nucleic acid has the sequence set forth in GENBANK Accession No. NM_000163.4 (incorporated herein as SEQ ID NO: 1), GENBANK Accession No. NT_006576.16 truncated from nucleotides 42411001 to 42714000 (incorporated herein as SEQ ID NO: 2), GENBANK Accession No X06562.1 (incorporated herein as SEQ ID NO: 3), GENBANK Accession No. DR006395.1 (incorporated herein as SEQ ID NO: 4), GENBANK Accession No. DB052048.1 (incorporated herein as SEQ ID NO: 5), GENBANK Accession No. AF230800.1 (incorporated herein as SEQ ID NO: 6), the complement of GENBANK Accession No. AA398260.1 (incorporated herein as SEQ ID NO: 7), GENBANK Accession No. BC136496.1 (incorporated herein as SEQ ID NO: 8), GENBANK Accession No. NM_001242399.2 (incorporated herein as SEQ ID NO: 9), GENBANK Accession No. NM_001242400.2 (incorporated herein as SEQ ID NO: 10), GENBANK Accession No. NM_001242401.3 (incorporated herein as SEQ ID NO: 11), GENBANK Accession No. NM_001242402.2 (incorporated herein as SEQ ID NO: 12), GENBANK Accession No. NM_001242403.2 (incorporated herein as SEQ ID NO: 13), GENBANK Accession No. NM_001242404.2 (incorporated herein as SEQ ID NO: 14), GENBANK Accession No. NM_001242405.2 (incorporated herein as SEQ ID NO: 15), GENBANK Accession No. NM_001242406.2 (incorporated herein as SEQ ID NO: 16), GENBANK Accession No. NM_001242460.1 (incorporated herein as SEQ ID NO: 17), GENBANK Accession NM_001242461.1 (incorporated herein as SEQ ID NO: 18), or GENBANK Accession No. NM_001242462.1 (incorporated herein as SEQ ID NO: 19).

Certain embodiments provide a compound comprising a modified oligonucleotide and a conjugate group, wherein the modified oligonucleotide consists of 10 to 30 linked nucleosides and has a nucleobase sequence comprising at least 8 contiguous nucleobases of any of the nucleobase sequences of SEQ ID NOs: 20-2295.

Certain embodiments provide a compound comprising a modified oligonucleotide and a conjugate group, wherein the modified oligonucleotide consists of 10 to 30 linked nucleosides and has a nucleobase sequence comprising at least 9 contiguous nucleobases of any of the nucleobase sequences of SEQ ID NOs: 20-2295.

Certain embodiments provide a compound comprising a modified oligonucleotide and a conjugate group, wherein the modified oligonucleotide consists of 10 to 30 linked nucleosides and has a nucleobase sequence comprising at least 10 contiguous nucleobases of the nucleobase sequences of any of SEQ ID NOs: 20-2295.

Certain embodiments provide a compound comprising a modified oligonucleotide and a conjugate group, wherein the modified oligonucleotide consists of 10 to 30 linked nucleosides and has a nucleobase sequence comprising at least 11 contiguous nucleobases of the nucleobase sequences of any of SEQ ID NOs: 20-2295.

Certain embodiments provide a compound comprising a modified oligonucleotide and a conjugate group, wherein the modified oligonucleotide consists of 10 to 30 linked nucleosides and has a nucleobase sequence comprising at least 12 contiguous nucleobases of the nucleobase sequences of any of SEQ ID NOs: 20-2295.

Certain embodiments provide a compound comprising a modified oligonucleotide and a conjugate group, wherein the modified oligonucleotide consists of 10 to 30 linked nucleosides and has a nucleobase sequence comprising the nucleobase sequences of any of SEQ ID NOs: 20-2295.

Certain embodiments provide a compound comprising a modified oligonucleotide and a conjugate group, wherein the modified oligonucleotide consists of the nucleobase sequences of any one of SEQ ID NOs: 20-2295.

Certain embodiments provide a compound comprising a modified oligonucleotide and a conjugate group, wherein the modified oligonucleotide consists of 10 to 30 linked nucleosides complementary within nucleotides 30-51, 63-82, 103-118, 143-159, 164-197, 206-259, 361-388, 554-585, 625-700, 736-776, 862-887, 923-973, 978-996, 1127-1142, 1170-1195, 1317-1347, 1360-1383, 1418-1449, 1492-1507, 1524-1548, 1597-1634, 1641-1660, 1683-1698, 1744-1768, 1827-1860, 1949-2002, 2072-2092, 2095-2110, 2306-2321, 2665-2683, 2685-2719, 2739-2770, 2859-2880, 2941-2960, 2963-2978, 3037-3052, 3205-3252, 3306-3332, 3371-3386, 3518-3542, 3975-3990, 4041-4087, 4418-4446, 4528-4546, 7231-7246, 7570-7585, 8395-8410, 9153-9168, 9554-9569, 9931-9946, 10549-10564, 11020-11035, 11793-11808, 12214-12229, 12474-12489, 12905-12920, 13400-13415, 13717-13732, 14149-14164, 14540-14555, 15264-15279, 15849-15864, 16530-16545, 17377-17392, 17581-17596, 17943-17958, 18353-18368, 18636-18651, 19256-19271, 19814-19829, 20365-20380, 20979-20994, 21566-21581, 22150-22165, 22803-22818, 29049-29064, 29554-29569, 30245-30260, 30550-30565, 30915-30930, 31468-31483, 32366-32381, 32897-32912, 33187-33202, 33780-33795, 34407-34422, 34846-34861, 35669-35684, 36312-36327, 36812-36827, 37504-37519, 38841-38856, 40250-40265, 40706-40721, 40922-40937, 41424-41439, 41999-42014, 42481-42496, 42700-42715, 43291-43306, 43500-43515, 43947-43962, 44448-44463, 45162-45177, 46010-46025, 46476-46491, 47447-47462, 47752-47767, 48001-48016, 48423-48438, 50195-50210, 50470-50485, 51104-51119, 51756-51771, 52015-52030, 52230-52245, 52588-52603, 53532-53547, or 54645-54660 of SEQ ID NO: 1, wherein said modified oligonucleotide is at least 90% complementary to SEQ ID NO: 1.

Certain embodiments provide a compound comprising a modified oligonucleotide and a conjugate group, wherein the modified oligonucleotide consists of 10 to 30 linked nucleosides having a nucleobase sequence comprising a portion of at least 8 contiguous nucleobases 100% complementary to an equal length portion of nucleobases 30-51, 63-82, 103-118, 143-159, 164-197, 206-259, 361-388, 554-585, 625-700, 736-776, 862-887, 923-973, 978-996, 1127-1142, 1170-1195, 1317-1347, 1360-1383, 1418-1449, 1492-1507, 1524-1548, 1597-1634, 1641-1660, 1683-1698, 1744-1768, 1827-1860, 1949-2002, 2072-2092, 2095-2110, 2306-2321, 2665-2683, 2685-2719, 2739-2770, 2859-2880, 2941-2960, 2963-2978, 3037-3052, 3205-3252, 3306-3332, 3371-3386, 3518-3542, 3975-3990, 4041-4087, 4418-4446, 4528-4546, 7231-7246, 7570-7585, 8395-8410, 9153-9168, 9554-9569, 9931-9946, 10549-10564, 11020-11035, 11793-11808, 12214-12229, 12474-12489, 12905-12920, 13400-13415, 13717-13732, 14149-14164, 14540-14555, 15264-15279, 15849-15864, 16530-16545, 17377-17392, 17581-17596, 17943-17958, 18353-18368, 18636-18651, 19256-19271, 19814-19829, 20365-20380, 20979-20994, 21566-21581, 22150-22165, 22803-22818, 29049-29064, 29554-29569, 30245-30260, 30550-30565, 30915-30930, 31468-31483, 32366-32381, 32897-32912, 33187-33202, 33780-33795, 34407-34422, 34846-34861, 35669-35684, 36312-36327, 36812-36827, 37504-37519, 38841-38856, 40250-40265, 40706-40721, 40922-40937, 41424-41439, 41999-42014, 42481-42496, 42700-42715, 43291-43306, 43500-43515, 43947-43962, 44448-44463, 45162-45177, 46010-46025, 46476-46491, 47447-47462, 47752-47767, 48001-48016, 48423-48438, 50195-50210, 50470-50485, 51104-51119, 51756-51771, 52015-52030, 52230-52245, 52588-52603, 53532-53547, or 54645-54660 of SEQ ID NO: 1, wherein the nucleobase sequence of the modified oligonucleotide is complementary to SEQ ID NO: 1.

Certain embodiments provide a compound comprising a modified oligonucleotide and a conjugate group, wherein the modified oligonucleotide consists of 10 to 30 linked nucleosides complementary within nucleotides 2571-2586, 2867-3059, 3097-3116, 3341-3695, 4024-4039, 4446-4894, 5392-5817, 6128-6265, 6499-6890, 7231-7246, 8395-8410, 9153-9168, 9554-9569, 9931-9946, 10549-10564, 10660-10679, 11020-11035, 11793-12229, 12469-12920, 13351-13415, 13717-13732, 14149-14164, 14361-14555, 14965-15279, 15849-16001, 16253-16272, 16447-16545, 17130-17149, 17377-17669, 17927-17958, 18353-18368, 18636-18773, 19661-19918, 20288-20470, 20979-20994, 21215-21606, 21820-21837, 22150-22165, 22518-22536, 22803-22818, 26494-26522, 29049-29069, 29323-29489, 30550-30565, 30915-31191, 31468-31483, 32363-32382, 32827-33202, 33635-33795, 34138-34157, 34407-34422, 34845-34864, 35466-35485, 35669-35684, 36023-36042, 36266-36327, 36721-36827, 37032-37130, 37276-37295, 37504-37675, 38094-38118, 38841-38856, 39716-40538, 40706-40937, 41164-41183, 41342-41439, 42141-42164, 42700-42760, 43173-43537, 43765-46025, 46476-46532, 48423-48438, 50072-50210, 50470-50485, 50719-51234, 51747-51797, 52015-52143, 52230-52245, 52573-52652, 53466-54660, 54886-54901, 63751-64662, 64882-65099, 65363-65378, 65600-65615, 65988-66183, 66566-66581, 66978-67080, 67251-67270, 67662-67929, 68727-68742, 69203-69242, 69565-69620, 69889-70145, 70352-70584, 70925-71071, 71314-71329, 71617-71769, 72107-72241, 72584-72670, 73061-73076, 73350-73369, 73689-73723, 74107-74131, 74317-74557, 74947-75009, 75192-75207, 75979-76066, 76410-77095, 77292-77307, 77638-77869, 78122-78326, 79006-79021, 79478-79505, 80277-80292, 80575-80939, 81207-81222, 81524-81543, 81761-81776, 82233-82248, 82738-83198, 83330-83416, 83884-84063, 84381-85964, 86220-86392, 86554-86655, 86901-86920, 87181-87262, 88063-88082, 88293-88308, 88605-88967, 89160-89175, 89940-90255, 90473-90528, 91073-91088, 91273-91292, 91647-91662, 91930-92126, 92356-92371, 93190-93443, 93762-94111, 94374-94389, 94581-94653, 94839-94858, 95292-95583, 95829-95844, 96137-96503, 96793-97013, 97539-97554, 97800-97889, 98132-98151, 98624-98672, 98810-99115, 99258-99273, 99478-99503, 99791-99858, 100281-100300, 100406-100421, 100742-100828, 101080-101103, 101242-101320, 101788-101906, 102549-102568, 103566-103625, 104067-104086, 104277-104858, 105255-105274, 106147-106364, 106632-106647, 106964-107735, 108514-108788, 109336-109505, 109849-109864, 110403-110442, 110701-110974, 111203-111322, 112030-112049, 112499-112514, 112842-112861, 113028-113056, 113646-113665, 113896-113911, 114446-114465, 115087-115106, 119269-119284, 119659-119703, 120376-120497, 120738-120845, 121209-121228, 121823-122013, 122180-122199, 122588-122770, 123031-123050, 123152-123167, 123671-124055, 124413-124608, 125178-125197, 125533-125616, 126357-126434, 126736-126751, 126998-127236, 127454-127682, 128467-128482, 128813-129111, 129976-130013, 130308-130323, 131036-131056, 131286-131305, 131676-131691, 132171-132517, 133168-133241, 133522-133877, 134086-134101, 134240-134259, 134441-134617, 135015-135030, 135431-135519, 135818-135874, 136111-136130, 136282-136595, 136996-137152, 137372-137387, 137750-137765, 138048-138067, 138782-139840, 140343-140358, 140593-140701, 141116-141131, 141591-141719, 142113-142342, 143021-143048, 143185-143486, 143836-144109, 144558-144650, 144990-145078, 145428-145525, 145937-145952, 146235-146386, 147028-147043, 147259-147284, 147671-147686, 148059-148154, 148564-148579, 148904-149084, 149491-149506, 149787-149877, 150236-150251, 150588-151139, 151373-151659, 152201-152388, 152549-152771, 153001-153026, 153349-153364, 153831-154112, 154171-154186, 154502-154521, 154724-154828, 155283-155304, 155591-155616, 155889-155992, 156233-156612, 156847-156907, 157198-157223, 157330-157349, 157552-157567, 157927-158029, 158542-158631, 159216-159267, 159539-159793, 160352-160429, 160812-160827, 161248-161267, 161461-161607, 161821-161969, 162064-162083, 162132-162147, 162531-162770, 163019-163557, 164839-165059, 165419-165575, 165856-165875, 166241-166450, 166837-166852, 167107-167122, 168004-168019, 168760-168823, 169062-169092, 169134-169153, 169601-169711, 170081-170291, 170407-170426, 170703-170814, 171021-171036, 171207-171226, 171431-171568, 171926-171945, 172447-172462, 172733-172956, 173045-173756, 174122-174885, 175014-177830, 178895-180539, 181514-187644, 187857-189904, 190109-194159, 194425-195723, 196536-196873, 197326-197961, 198145-198170, 198307-198381, 198715-199007, 199506-199563, 199816-199838, 200249-200635, 201258-201861, 202079-202094, 202382-202717, 203098-203934, 204181-204740, 205549-205915, 206412-206764, 207510-207532, 209999-210014, 210189-210296, 210502-210583, 210920-211418, 211836-212223, 212606-212816, 213025-213044, 213425-213440, 213825-213933, 214479-214498, 214622-214647, 214884-214951, 215446-215508, 215932-215951, 216192-217595, 218132-218248, 218526-218541, 218734-21219037, 219342-219633, 219886-220705, 221044-221059, 221483-221607, 221947-221962, 222569-222584, 222914-222998, 223436-223451, 223948-224122, 224409-224430, 224717-224769, 225133-225148, 225436-225761, 226785-226898, 227025-227040, 227218-227251, 227485-227500, 227914-228837, 229174-229189, 229423-229438, 229615-229640, 230042-230057, 230313-230595, 231218-231345, 231817-232037, 232088-232408, 232823-232848, 232884-232899, 233210-233225, 233623-233646, 234447-234466, 234876-234918, 235258-235328, 235770-235785, 236071-236213, 236684-237196, 237585-237698, 237949-237557, 244873-244897, 245319-245334, 245701-245780, 246152-246523, 246936-247031, 247203-247240, 247431-247450, 247644-247659, 248223-248363, 248694-248762, 249494-249509, 250001-250020, 250693-250708, 251214-251233, 251601-251637, 251950-252060, 252665-252680, 252838-252863, 253140-253166, 253594-253819, 254036-254083, 254246-254345, 254641-254660, 254905-254920, 255397-255422, 255618-255633, 255992-256704, 257018-257092, 257317-257332, 257818-259305, 259500-259515, 261294-261656, 262021-262036, 262453-262779, 263338-266518, 266861-267131, 267375-268051, 268366-269447, 270038-271850, 271950-271969, 272631-274145, 274205-275747, 275808-276636, 276932-277064, 277391-278380, 278932-279063, 279303-281001, 281587-281610, 282229-283668, 290035-290474, 290924-292550, 292860-294408, 295475-297012, 297587-298115, 298161-298418, 298489-298738, 299082-299187, 299276-299669, 299723-299749, 299788-300504, or 300835-301295 of SEQ ID NO: 2, wherein said modified oligonucleotide is at least 90% complementary to SEQ ID NO: 2.

Certain embodiments provide a compound comprising a modified oligonucleotide and a conjugate group, wherein the modified oligonucleotide consists of 10 to 30 linked nucleosides having a nucleobase sequence comprising a portion of at least 8 contiguous nucleobases 100% complementary to an equal length portion of nucleobases 2571-2586, 2867-3059, 3097-3116, 3341-3695, 4024-4039, 4446-4894, 5392-5817, 6128-6265, 6499-6890, 7231-7246, 8395-8410, 9153-9168, 9554-9569, 9931-9946, 10549-10564, 10660-10679, 11020-11035, 11793-12229, 12469-12920, 13351-13415, 13717-13732, 14149-14164, 14361-14555, 14965-15279, 15849-16001, 16253-16272, 16447-16545, 17130-17149, 17377-17669, 17927-17958, 18353-18368, 18636-18773, 19661-19918, 20288-20470, 20979-20994, 21215-21606, 21820-21837, 22150-22165, 22518-22536, 22803-22818, 26494-26522, 29049-29069, 29323-29489, 30550-30565, 30915-31191, 31468-31483, 32363-32382, 32827-33202, 33635-33795, 34138-34157, 34407-34422, 34845-34864, 35466-35485, 35669-35684, 36023-36042, 36266-36327, 36721-36827, 37032-37130, 37276-37295, 37504-37675, 38094-38118, 38841-38856, 39716-40538, 40706-40937, 41164-41183, 41342-41439, 42141-42164, 42700-42760, 43173-43537, 43765-46025, 46476-46532, 48423-48438, 50072-50210, 50470-50485, 50719-51234, 51747-51797, 52015-52143, 52230-52245, 52573-52652, 53466-54660, 54886-54901, 63751-64662, 64882-65099, 65363-65378, 65600-65615, 65988-66183, 66566-66581, 66978-67080, 67251-67270, 67662-67929, 68727-68742, 69203-69242, 69565-69620, 69889-70145, 70352-70584, 70925-71071, 71314-71329, 71617-71769, 72107-72241, 72584-72670, 73061-73076, 73350-73369, 73689-73723, 74107-74131, 74317-74557, 74947-75009, 75192-75207, 75979-76066, 76410-77095, 77292-77307, 77638-77869, 78122-78326, 79006-79021, 79478-79505, 80277-80292, 80575-80939, 81207-81222, 81524-81543, 81761-81776, 82233-82248, 82738-83198, 83330-83416, 83884-84063, 84381-85964, 86220-86392, 86554-86655, 86901-86920, 87181-87262, 88063-88082, 88293-88308, 88605-88967, 89160-89175, 89940-90255, 90473-90528, 91073-91088, 91273-91292, 91647-91662, 91930-92126, 92356-92371, 93190-93443, 93762-94111, 94374-94389, 94581-94653, 94839-94858, 95292-95583, 95829-95844, 96137-96503, 96793-97013, 97539-97554, 97800-97889, 98132-98151, 98624-98672, 98810-99115, 99258-99273, 99478-99503, 99791-99858, 100281-100300, 100406-100421, 100742-100828, 101080-101103, 101242-101320, 101788-101906, 102549-102568, 103566-103625, 104067-104086, 104277-104858, 105255-105274, 106147-106364, 106632-106647, 106964-107735, 108514-108788, 109336-109505, 109849-109864, 110403-110442, 110701-110974, 111203-111322, 112030-112049, 112499-112514, 112842-112861, 113028-113056, 113646-113665, 113896-113911, 114446-114465, 115087-115106, 119269-119284, 119659-119703, 120376-120497, 120738-120845, 121209-121228, 121823-122013, 122180-122199, 122588-122770, 123031-123050, 123152-123167, 123671-124055, 124413-124608, 125178-125197, 125533-125616, 126357-126434, 126736-126751, 126998-127236, 127454-127682, 128467-128482, 128813-129111, 129976-130013, 130308-130323, 131036-131056, 131286-131305, 131676-131691, 132171-132517, 133168-133241, 133522-133877, 134086-134101, 134240-134259, 134441-134617, 135015-135030, 135431-135519, 135818-135874, 136111-136130, 136282-136595, 136996-137152, 137372-137387, 137750-137765, 138048-138067, 138782-139840, 140343-140358, 140593-140701, 141116-141131, 141591-141719, 142113-142342, 143021-143048, 143185-143486, 143836-144109, 144558-144650, 144990-145078, 145428-145525, 145937-145952, 146235-146386, 147028-147043, 147259-147284, 147671-147686, 148059-148154, 148564-148579, 148904-149084, 149491-149506, 149787-149877, 150236-150251, 150588-151139, 151373-151659, 152201-152388, 152549-152771, 153001-153026, 153349-153364, 153831-154112, 154171-154186, 154502-154521, 154724-154828, 155283-155304, 155591-155616, 155889-155992, 156233-156612, 156847-156907, 157198-157223, 157330-157349, 157552-157567, 157927-158029, 158542-158631, 159216-159267, 159539-159793, 160352-160429, 160812-160827, 161248-161267, 161461-161607, 161821-161969, 162064-162083, 162132-162147, 162531-162770, 163019-163557, 164839-165059, 165419-165575, 165856-165875, 166241-166450, 166837-166852, 167107-167122, 168004-168019, 168760-168823, 169062-169092, 169134-169153, 169601-169711, 170081-170291, 170407-170426, 170703-170814, 171021-171036, 171207-171226, 171431-171568, 171926-171945, 172447-172462, 172733-172956, 173045-173756, 174122-174885, 175014-177830, 178895-180539, 181514-187644, 187857-189904, 190109-194159, 194425-195723, 196536-196873, 197326-197961, 198145-198170, 198307-198381, 198715-199007, 199506-199563, 199816-199838, 200249-200635, 201258-201861, 202079-202094, 202382-202717, 203098-203934, 204181-204740, 205549-205915, 206412-206764, 207510-207532, 209999-210014, 210189-210296, 210502-210583, 210920-211418, 211836-212223, 212606-212816, 213025-213044, 213425-213440, 213825-213933, 214479-214498, 214622-214647, 214884-214951, 215446-215508, 215932-215951, 216192-217595, 218132-218248, 218526-218541, 218734-21219037, 219342-219633, 219886-220705, 221044-221059, 221483-221607, 221947-221962, 222569-222584, 222914-222998, 223436-223451, 223948-224122, 224409-224430, 224717-224769, 225133-225148, 225436-225761, 226785-226898, 227025-227040, 227218-227251, 227485-227500, 227914-228837, 229174-229189, 229423-229438, 229615-229640, 230042-230057, 230313-230595, 231218-231345, 231817-232037, 232088-232408, 232823-232848, 232884-232899, 233210-233225, 233623-233646, 234447-234466, 234876-234918, 235258-235328, 235770-235785, 236071-236213, 236684-237196, 237585-237698, 237949-237557, 244873-244897, 245319-245334, 245701-245780, 246152-246523, 246936-247031, 247203-247240, 247431-247450, 247644-247659, 248223-248363, 248694-248762, 249494-249509, 250001-250020, 250693-250708, 251214-251233, 251601-251637, 251950-252060, 252665-252680, 252838-252863, 253140-253166, 253594-253819, 254036-254083, 254246-254345, 254641-254660, 254905-254920, 255397-255422, 255618-255633, 255992-256704, 257018-257092, 257317-257332, 257818-259305, 259500-259515, 261294-261656, 262021-262036, 262453-262779, 263338-266518, 266861-267131, 267375-268051, 268366-269447, 270038-271850, 271950-271969, 272631-274145, 274205-275747, 275808-276636, 276932-277064, 277391-278380, 278932-279063, 279303-281001, 281587-281610, 282229-283668, 290035-290474, 290924-292550, 292860-294408, 295475-297012, 297587-298115, 298161-298418, 298489-298738, 299082-299187, 299276-299669, 299723-299749, 299788-300504, or 300835-301295 of SEQ ID NO: 2, wherein the nucleobase sequence of the modified oligonucleotide is complementary to SEQ ID NO: 2. In certain aspects, the compound comprises a modified oligonucleotide consisting of 10 to 30 linked nucleosides complementary within nucleotides 155594-155613, 72107-72126, 153921-153940, 159252-159267, 213425-213440, 153004-153019, 155597-155612, 248233-248248 of SEQ ID NO: 2.

Certain embodiments provide a compound comprising a modified oligonucleotide and a conjugate group, wherein the modified oligonucleotide consists of 10 to 30 linked nucleosides and having a nucleobase sequence comprising the nucleobase sequence of any one of SEQ ID NOs: 20-2295.

Certain embodiments provide a compound comprising a modified oligonucleotide and a conjugate group, wherein the modified oligonucleotide consists of the nucleobase sequence of any one of SEQ ID NOs: 20-2295.

In certain embodiments, a compound comprising an antisense compound or oligonucleotide and a conjugate group, wherein the antisense compound or oligonucleotide is targeted to a growth hormone receptor nucleic acid and is complementary within the following nucleotide regions of SEQ ID NO: 1: 30-51, 63-82, 103-118, 143-159, 164-197, 206-259, 361-388, 554-585, 625-700, 736-776, 862-887, 923-973, 978-996, 1127-1142, 1170-1195, 1317-1347, 1360-1383, 1418-1449, 1492-1507, 1524-1548, 1597-1634, 1641-1660, 1683-1698, 1744-1768, 1827-1860, 1949-2002, 2072-2092, 2095-2110, 2306-2321, 2665-2683, 2685-2719, 2739-2770, 2859-2880, 2941-2960, 2963-2978, 3037-3052, 3205-3252, 3306-3332, 3371-3386, 3518-3542, 3975-3990, 4041-4087, 4418-4446, 4528-4546, 7231-7246, 7570-7585, 8395-8410, 9153-9168, 9554-9569, 9931-9946, 10549-10564, 11020-11035, 11793-11808, 12214-12229, 12474-12489, 12905-12920, 13400-13415, 13717-13732, 14149-14164, 14540-14555, 15264-15279, 15849-15864, 16530-16545, 17377-17392, 17581-17596, 17943-17958, 18353-18368, 18636-18651, 19256-19271, 19814-19829, 20365-20380, 20979-20994, 21566-21581, 22150-22165, 22803-22818, 29049-29064, 29554-29569, 30245-30260, 30550-30565, 30915-30930, 31468-31483, 32366-32381, 32897-32912, 33187-33202, 33780-33795, 34407-34422, 34846-34861, 35669-35684, 36312-36327, 36812-36827, 37504-37519, 38841-38856, 40250-40265, 40706-40721, 40922-40937, 41424-41439, 41999-42014, 42481-42496, 42700-42715, 43291-43306, 43500-43515, 43947-43962, 44448-44463, 45162-45177, 46010-46025, 46476-46491, 47447-47462, 47752-47767, 48001-48016, 48423-48438, 50195-50210, 50470-50485, 51104-51119, 51756-51771, 52015-52030, 52230-52245, 52588-52603, 53532-53547, or 54645-54660.

In certain embodiments, a compound comprising an antisense compound or oligonucleotide and a conjugate group, wherein the antisense compound or oligonucleotide is targeted to a growth hormone receptor nucleic acid and targets the following nucleotide regions of SEQ ID NO: 1: 30-51, 63-82, 103-118, 143-159, 164-197, 206-259, 361-388, 554-585, 625-700, 736-776, 862-887, 923-973, 978-996, 1127-1142, 1170-1195, 1317-1347, 1360-1383, 1418-1449, 1492-1507, 1524-1548, 1597-1634, 1641-1660, 1683-1698, 1744-1768, 1827-1860, 1949-2002, 2072-2092, 2095-2110, 2306-2321, 2665-2683, 2685-2719, 2739-2770, 2859-2880, 2941-2960, 2963-2978, 3037-3052, 3205-3252, 3306-3332, 3371-3386, 3518-3542, 3975-3990, 4041-4087, 4418-4446, 4528-4546, 7231-7246, 7570-7585, 8395-8410, 9153-9168, 9554-9569, 9931-9946, 10549-10564, 11020-11035, 11793-11808, 12214-12229, 12474-12489, 12905-12920, 13400-13415, 13717-13732, 14149-14164, 14540-14555, 15264-15279, 15849-15864, 16530-16545, 17377-17392, 17581-17596, 17943-17958, 18353-18368, 18636-18651, 19256-19271, 19814-19829, 20365-20380, 20979-20994, 21566-21581, 22150-22165, 22803-22818, 29049-29064, 29554-29569, 30245-30260, 30550-30565, 30915-30930, 31468-31483, 32366-32381, 32897-32912, 33187-33202, 33780-33795, 34407-34422, 34846-34861, 35669-35684, 36312-36327, 36812-36827, 37504-37519, 38841-38856, 40250-40265, 40706-40721, 40922-40937, 41424-41439, 41999-42014, 42481-42496, 42700-42715, 43291-43306, 43500-43515, 43947-43962, 44448-44463, 45162-45177, 46010-46025, 46476-46491, 47447-47462, 47752-47767, 48001-48016, 48423-48438, 50195-50210, 50470-50485, 51104-51119, 51756-51771, 52015-52030, 52230-52245, 52588-52603, 53532-53547, or 54645-54660.

In certain embodiments, a compound comprises an antisense compound or oligonucleotide and a conjugate group, wherein the antisense compound or oligonucleotide is targeted to a region of a growth hormone receptor nucleic acid. In certain embodiments, such compounds or oligonucleotides targeted to a region of a GHR nucleic acid have a contiguous nucleobase portion that is complementary to an equal length nucleobase portion of the region. For example, the portion can be at least an 8, 9, 10, 11, 12, 13, 14, 15, or 16 contiguous nucleobases portion complementary to an equal length portion of a region recited herein. In certain embodiments, such compounds or oligonucleotide target the following nucleotide regions of SEQ ID NO: 1:30-51, 63-82, 103-118, 143-159, 164-197, 206-259, 361-388, 554-585, 625-700, 736-776, 862-887, 923-973, 978-996, 1127-1142, 1170-1195, 1317-1347, 1360-1383, 1418-1449, 1492-1507, 1524-1548, 1597-1634, 1641-1660, 1683-1698, 1744-1768, 1827-1860, 1949-2002, 2072-2092, 2095-2110, 2306-2321, 2665-2683, 2685-2719, 2739-2770, 2859-2880, 2941-2960, 2963-2978, 3037-3052, 3205-3252, 3306-3332, 3371-3386, 3518-3542, 3975-3990, 4041-4087, 4418-4446, 4528-4546, 7231-7246, 7570-7585, 8395-8410, 9153-9168, 9554-9569, 9931-9946, 10549-10564, 11020-11035, 11793-11808, 12214-12229, 12474-12489, 12905-12920, 13400-13415, 13717-13732, 14149-14164, 14540-14555, 15264-15279, 15849-15864, 16530-16545, 17377-17392, 17581-17596, 17943-17958, 18353-18368, 18636-18651, 19256-19271, 19814-19829, 20365-20380, 20979-20994, 21566-21581, 22150-22165, 22803-22818, 29049-29064, 29554-29569, 30245-30260, 30550-30565, 30915-30930, 31468-31483, 32366-32381, 32897-32912, 33187-33202, 33780-33795, 34407-34422, 34846-34861, 35669-35684, 36312-36327, 36812-36827, 37504-37519, 38841-38856, 40250-40265, 40706-40721, 40922-40937, 41424-41439, 41999-42014, 42481-42496, 42700-42715, 43291-43306, 43500-43515, 43947-43962, 44448-44463, 45162-45177, 46010-46025, 46476-46491, 47447-47462, 47752-47767, 48001-48016, 48423-48438, 50195-50210, 50470-50485, 51104-51119, 51756-51771, 52015-52030, 52230-52245, 52588-52603, 53532-53547, or 54645-54660.

In certain embodiments, a compound comprising an antisense compound or oligonucleotide and a conjugate group, wherein the antisense compound or oligonucleotide is targeted to a growth hormone receptor nucleic acid is complementary within the following nucleotide regions of SEQ ID NO: 2: 2571-2586, 2867-3059, 3097-3116, 3341-3695, 4024-4039, 4446-4894, 5392-5817, 6128-6265, 6499-6890, 7231-7246, 8395-8410, 9153-9168, 9554-9569, 9931-9946, 10549-10564, 10660-10679, 11020-11035, 11793-12229, 12469-12920, 13351-13415, 13717-13732, 14149-14164, 14361-14555, 14965-15279, 15849-16001, 16253-16272, 16447-16545, 17130-17149, 17377-17669, 17927-17958, 18353-18368, 18636-18773, 19661-19918, 20288-20470, 20979-20994, 21215-21606, 21820-21837, 22150-22165, 22518-22536, 22803-22818, 26494-26522, 29049-29069, 29323-29489, 30550-30565, 30915-31191, 31468-31483, 32363-32382, 32827-33202, 33635-33795, 34138-34157, 34407-34422, 34845-34864, 35466-35485, 35669-35684, 36023-36042, 36266-36327, 36721-36827, 37032-37130, 37276-37295, 37504-37675, 38094-38118, 38841-38856, 39716-40538, 40706-40937, 41164-41183, 41342-41439, 42141-42164, 42700-42760, 43173-43537, 43765-46025, 46476-46532, 48423-48438, 50072-50210, 50470-50485, 50719-51234, 51747-51797, 52015-52143, 52230-52245, 52573-52652, 53466-54660, 54886-54901, 63751-64662, 64882-65099, 65363-65378, 65600-65615, 65988-66183, 66566-66581, 66978-67080, 67251-67270, 67662-67929, 68727-68742, 69203-69242, 69565-69620, 69889-70145, 70352-70584, 70925-71071, 71314-71329, 71617-71769, 72107-72241, 72584-72670, 73061-73076, 73350-73369, 73689-73723, 74107-74131, 74317-74557, 74947-75009, 75192-75207, 75979-76066, 76410-77095, 77292-77307, 77638-77869, 78122-78326, 79006-79021, 79478-79505, 80277-80292, 80575-80939, 81207-81222, 81524-81543, 81761-81776, 82233-82248, 82738-83198, 83330-83416, 83884-84063, 84381-85964, 86220-86392, 86554-86655, 86901-86920, 87181-87262, 88063-88082, 88293-88308, 88605-88967, 89160-89175, 89940-90255, 90473-90528, 91073-91088, 91273-91292, 91647-91662, 91930-92126, 92356-92371, 93190-93443, 93762-94111, 94374-94389, 94581-94653, 94839-94858, 95292-95583, 95829-95844, 96137-96503, 96793-97013, 97539-97554, 97800-97889, 98132-98151, 98624-98672, 98810-99115, 99258-99273, 99478-99503, 99791-99858, 100281-100300, 100406-100421, 100742-100828, 101080-101103, 101242-101320, 101788-101906, 102549-102568, 103566-103625, 104067-104086, 104277-104858, 105255-105274, 106147-106364, 106632-106647, 106964-107735, 108514-108788, 109336-109505, 109849-109864, 110403-110442, 110701-110974, 111203-111322, 112030-112049, 112499-112514, 112842-112861, 113028-113056, 113646-113665, 113896-113911, 114446-114465, 115087-115106, 119269-119284, 119659-119703, 120376-120497, 120738-120845, 121209-121228, 121823-122013, 122180-122199, 122588-122770, 123031-123050, 123152-123167, 123671-124055, 124413-124608, 125178-125197, 125533-125616, 126357-126434, 126736-126751, 126998-127236, 127454-127682, 128467-128482, 128813-129111, 129976-130013, 130308-130323, 131036-131056, 131286-131305, 131676-131691, 132171-132517, 133168-133241, 133522-133877, 134086-134101, 134240-134259, 134441-134617, 135015-135030, 135431-135519, 135818-135874, 136111-136130, 136282-136595, 136996-137152, 137372-137387, 137750-137765, 138048-138067, 138782-139840, 140343-140358, 140593-140701, 141116-141131, 141591-141719, 142113-142342, 143021-143048, 143185-143486, 143836-144109, 144558-144650, 144990-145078, 145428-145525, 145937-145952, 146235-146386, 147028-147043, 147259-147284, 147671-147686, 148059-148154, 148564-148579, 148904-149084, 149491-149506, 149787-149877, 150236-150251, 150588-151139, 151373-151659, 152201-152388, 152549-152771, 153001-153026, 153349-153364, 153831-154112, 154171-154186, 154502-154521, 154724-154828, 155283-155304, 155591-155616, 155889-155992, 156233-156612, 156847-156907, 157198-157223, 157330-157349, 157552-157567, 157927-158029, 158542-158631, 159216-159267, 159539-159793, 160352-160429, 160812-160827, 161248-161267, 161461-161607, 161821-161969, 162064-162083, 162132-162147, 162531-162770, 163019-163557, 164839-165059, 165419-165575, 165856-165875, 166241-166450, 166837-166852, 167107-167122, 168004-168019, 168760-168823, 169062-169092, 169134-169153, 169601-169711, 170081-170291, 170407-170426, 170703-170814, 171021-171036, 171207-171226, 171431-171568, 171926-171945, 172447-172462, 172733-172956, 173045-173756, 174122-174885, 175014-177830, 178895-180539, 181514-187644, 187857-189904, 190109-194159, 194425-195723, 196536-196873, 197326-197961, 198145-198170, 198307-198381, 198715-199007, 199506-199563, 199816-199838, 200249-200635, 201258-201861, 202079-202094, 202382-202717, 203098-203934, 204181-204740, 205549-205915, 206412-206764, 207510-207532, 209999-210014, 210189-210296, 210502-210583, 210920-211418, 211836-212223, 212606-212816, 213025-213044, 213425-213440, 213825-213933, 214479-214498, 214622-214647, 214884-214951, 215446-215508, 215932-215951, 216192-217595, 218132-218248, 218526-218541, 218734-21219037, 219342-219633, 219886-220705, 221044-221059, 221483-221607, 221947-221962, 222569-222584, 222914-222998, 223436-223451, 223948-224122, 224409-224430, 224717-224769, 225133-225148, 225436-225761, 226785-226898, 227025-227040, 227218-227251, 227485-227500, 227914-228837, 229174-229189, 229423-229438, 229615-229640, 230042-230057, 230313-230595, 231218-231345, 231817-232037, 232088-232408, 232823-232848, 232884-232899, 233210-233225, 233623-233646, 234447-234466, 234876-234918, 235258-235328, 235770-235785, 236071-236213, 236684-237196, 237585-237698, 237949-237557, 244873-244897, 245319-245334, 245701-245780, 246152-246523, 246936-247031, 247203-247240, 247431-247450, 247644-247659, 248223-248363, 248694-248762, 249494-249509, 250001-250020, 250693-250708, 251214-251233, 251601-251637, 251950-252060, 252665-252680, 252838-252863, 253140-253166, 253594-253819, 254036-254083, 254246-254345, 254641-254660, 254905-254920, 255397-255422, 255618-255633, 255992-256704, 257018-257092, 257317-257332, 257818-259305, 259500-259515, 261294-261656, 262021-262036, 262453-262779, 263338-266518, 266861-267131, 267375-268051, 268366-269447, 270038-271850, 271950-271969, 272631-274145, 274205-275747, 275808-276636, 276932-277064, 277391-278380, 278932-279063, 279303-281001, 281587-281610, 282229-283668, 290035-290474, 290924-292550, 292860-294408, 295475-297012, 297587-298115, 298161-298418, 298489-298738, 299082-299187, 299276-299669, 299723-299749, 299788-300504, or 300835-301295.

In certain embodiments, a compound comprising an antisense compound or oligonucleotide and a conjugate group, wherein the antisense compound or oligonucleotide is targeted to a growth hormone receptor nucleic acid targets the following nucleotide regions of SEQ ID NO: 2: 2571-2586, 2867-3059, 3097-3116, 3341-3695, 4024-4039, 4446-4894, 5392-5817, 6128-6265, 6499-6890, 7231-7246, 8395-8410, 9153-9168, 9554-9569, 9931-9946, 10549-10564, 10660-10679, 11020-11035, 11793-12229, 12469-12920, 13351-13415, 13717-13732, 14149-14164, 14361-14555, 14965-15279, 15849-16001, 16253-16272, 16447-16545, 17130-17149, 17377-17669, 17927-17958, 18353-18368, 18636-18773, 19661-19918, 20288-20470, 20979-20994, 21215-21606, 21820-21837, 22150-22165, 22518-22536, 22803-22818, 26494-26522, 29049-29069, 29323-29489, 30550-30565, 30915-31191, 31468-31483, 32363-32382, 32827-33202, 33635-33795, 34138-34157, 34407-34422, 34845-34864, 35466-35485, 35669-35684, 36023-36042, 36266-36327, 36721-36827, 37032-37130, 37276-37295, 37504-37675, 38094-38118, 38841-38856, 39716-40538, 40706-40937, 41164-41183, 41342-41439, 42141-42164, 42700-42760, 43173-43537, 43765-46025, 46476-46532, 48423-48438, 50072-50210, 50470-50485, 50719-51234, 51747-51797, 52015-52143, 52230-52245, 52573-52652, 53466-54660, 54886-54901, 63751-64662, 64882-65099, 65363-65378, 65600-65615, 65988-66183, 66566-66581, 66978-67080, 67251-67270, 67662-67929, 68727-68742, 69203-69242, 69565-69620, 69889-70145, 70352-70584, 70925-71071, 71314-71329, 71617-71769, 72107-72241, 72584-72670, 73061-73076, 73350-73369, 73689-73723, 74107-74131, 74317-74557, 74947-75009, 75192-75207, 75979-76066, 76410-77095, 77292-77307, 77638-77869, 78122-78326, 79006-79021, 79478-79505, 80277-80292, 80575-80939, 81207-81222, 81524-81543, 81761-81776, 82233-82248, 82738-83198, 83330-83416, 83884-84063, 84381-85964, 86220-86392, 86554-86655, 86901-86920, 87181-87262, 88063-88082, 88293-88308, 88605-88967, 89160-89175, 89940-90255, 90473-90528, 91073-91088, 91273-91292, 91647-91662, 91930-92126, 92356-92371, 93190-93443, 93762-94111, 94374-94389, 94581-94653, 94839-94858, 95292-95583, 95829-95844, 96137-96503, 96793-

97013, 97539-97554, 97800-97889, 98132-98151, 98624-98672, 98810-99115, 99258-99273, 99478-99503, 99791-99858, 100281-100300, 100406-100421, 100742-100828, 101080-101103, 101242-101320, 101788-101906, 102549-102568, 103566-103625, 104067-104086, 104277-104858, 105255-105274, 106147-106364, 106632-106647, 106964-107735, 108514-108788, 109336-109505, 109849-109864, 110403-110442, 110701-110974, 111203-111322, 112030-112049, 112499-112514, 112842-112861, 113028-113056, 113646-113665, 113896-113911, 114446-114465, 115087-115106, 119269-119284, 119659-119703, 120376-120497, 120738-120845, 121209-121228, 121823-122013, 122180-122199, 122588-122770, 123031-123050, 123152-123167, 123671-124055, 124413-124608, 125178-125197, 125533-125616, 126357-126434, 126736-126751, 126998-127236, 127454-127682, 128467-128482, 128813-129111, 129976-130013, 130308-130323, 131036-131056, 131286-131305, 131676-131691, 132171-132517, 133168-133241, 133522-133877, 134086-134101, 134240-134259, 134441-134617, 135015-135030, 135431-135519, 135818-135874, 136111-136130, 136282-136595, 136996-137152, 137372-137387, 137750-137765, 138048-138067, 138782-139840, 140343-140358, 140593-140701, 141116-141131, 141591-141719, 142113-142342, 143021-143048, 143185-143486, 143836-144109, 144558-144650, 144990-145078, 145428-145525, 145937-145952, 146235-146386, 147028-147043, 147259-147284, 147671-147686, 148059-148154, 148564-148579, 148904-149084, 149491-149506, 149787-149877, 150236-150251, 150588-151139, 151373-151659, 152201-152388, 152549-152771, 153001-153026, 153349-153364, 153831-154112, 154171-154186, 154502-154521, 154724-154828, 155283-155304, 155591-155616, 155889-155992, 156233-156612, 156847-156907, 157198-157223, 157330-157349, 157552-157567, 157927-158029, 158542-158631, 159216-159267, 159539-159793, 160352-160429, 160812-160827, 161248-161267, 161461-161607, 161821-161969, 162064-162083, 162132-162147, 162531-162770, 163019-163557, 164839-165059, 165419-165575, 165856-165875, 166241-166450, 166837-166852, 167107-167122, 168004-168019, 168760-168823, 169062-169092, 169134-169153, 169601-169711, 170081-170291, 170407-170426, 170703-170814, 171021-171036, 171207-171226, 171431-171568, 171926-171945, 172447-172462, 172733-172956, 173045-173076, 174122-174885, 175014-177830, 178895-180539, 181514-187644, 187857-189904, 190109-194159, 194425-195723, 196536-196873, 197326-197961, 198145-198170, 198307-198381, 198715-199007, 199506-199563, 199816-199838, 200249-200635, 201258-201861, 202079-202094, 202382-202717, 203098-203934, 204181-204740, 205549-205915, 206412-206764, 207510-207532, 209999-210014, 210189-210296, 210502-210583, 210920-211418, 211836-212223, 212606-212816, 213025-213044, 213425-213440, 213825-213933, 214479-214498, 214622-214647, 214884-214951, 215446-215508, 215932-215951, 216192-217595, 218132-218248, 218526-218541, 218734-21219037, 219342-219633, 219886-220705, 221044-221059, 221483-221607, 221947-221962, 222569-222584, 222914-222998, 223436-223451, 223948-224122, 224409-224430, 224717-224769, 225133-225148, 225436-225761, 226785-226898, 227025-227040, 227218-227251, 227485-227500, 227914-228837, 229174-229189, 229423-229438, 229615-229640, 230042-230057, 230313-230595, 231218-231345, 231817-232037, 232088-232408, 232823-232848, 232884-232899, 233210-233225, 233623-233646, 234447-234466, 234876-234918, 235258-235328, 235770-235785, 236071-236213, 236684-237196, 237585-237698, 237949-237557, 244873-244897, 245319-245334, 245701-245780, 246152-246523, 246936-247031, 247203-247240, 247431-247450, 247644-247659, 248223-248363, 248694-248762, 249494-249509, 250001-250020, 250693-250708, 251214-251233, 251601-251637, 251950-252260, 252665-252680, 252838-252863, 253140-253166, 253594-253819, 254036-254083, 254246-254345, 254641-254660, 254905-254920, 255397-255422, 255618-255633, 255992-256704, 257018-257092, 257317-257332, 257818-259305, 259500-259515, 261294-261656, 262021-262036, 262453-262779, 263338-266518, 266861-267131, 267375-268051, 268366-269447, 270038-271850, 271950-271969, 272631-274145, 274205-275747, 275808-276636, 276932-277064, 277391-278380, 278932-279063, 279303-281001, 281587-281610, 282229-283668, 290035-290474, 290924-292550, 292860-294408, 295475-297012, 297587-298115, 298161-298418, 298489-298738, 299082-299187, 299276-299669, 299723-299749, 299788-300504, or 300835-301295.

In certain embodiments, a compound comprises an antisense compound or oligonucleotide and a conjugate group, wherein the antisense compound or oligonucleotide is targeted to a region of a growth hormone receptor nucleic acid. In certain embodiments, such compounds or oligonucleotides targeted to a region of a GHR nucleic acid have a contiguous nucleobase portion that is complementary to an equal length nucleobase portion of the region. For example, the portion can be at least an 8, 9, 10, 11, 12, 13, 14, 15, or 16 contiguous nucleobases portion complementary to an equal length portion of a region recited herein. In certain embodiments, such compounds or oligonucleotide target the following nucleotide regions of SEQ ID NO: 2: 2571-2586, 2867-3059, 3097-3116, 3341-3695, 4024-4039, 4446-4894, 5392-5817, 6128-6265, 6499-6890, 7231-7246, 8395-8410, 9153-9168, 9554-9569, 9931-9946, 10549-10564, 10660-10679, 11020-11035, 11793-12229, 12469-12920, 13351-13415, 13717-13732, 14149-14164, 14361-14555, 14965-15279, 15849-16001, 16253-16272, 16447-16545, 17130-17149, 17377-17669, 17927-17958, 18353-18368, 18636-18773, 19661-19918, 20288-20470, 20979-20994, 21215-21606, 21820-21837, 22150-22165, 22518-22536, 22803-22818, 26494-26522, 29049-29069, 29323-29489, 30550-30565, 30915-31191, 31468-31483, 32363-32382, 32827-33202, 33635-33795, 34138-34157, 34407-34422, 34845-34864, 35466-35485, 35669-35684, 36023-36042, 36266-36327, 36721-36827, 37032-37130, 37276-37295, 37504-37675, 38094-38118, 38841-38856, 39716-40538, 40706-40937, 41164-41183, 41342-41439, 42141-42164, 42700-42760, 43173-43537, 43765-46025, 46476-46532, 48423-48438, 50072-50210, 50470-50485, 50719-51234, 51747-51797, 52015-52143, 52230-52245, 52573-52652, 53466-54660, 54886-54901, 63751-64662, 64882-65099, 65363-65378, 65600-65615, 65988-66183, 66566-66581, 66978-67080, 67251-67270, 67662-67929, 68727-68742, 69203-69242, 69565-69620, 69889-70145, 70352-70584, 70925-71071, 71314-71329, 71617-71769, 72107-72241, 72584-72670, 73061-73076, 73350-73369, 73689-73723, 74107-74131, 74317-74557, 74947-75009, 75192-75207, 75979-76066, 76410-77095, 77292-77307, 77638-77869, 78122-78326, 79006-79021, 79478-79505, 80277-80292, 80575-80939, 81207-81222, 81524-81543, 81761-81776, 82233-82248, 82738-83198, 83330-83416, 83884-84063, 84381-85964, 86220-86392, 86554-86655, 86901-86920, 87181-87262, 88063-88082, 88293-88308, 88605-88967, 89160-89175, 89940-90255, 90473-90528, 91073-91088, 91273-91292, 91647-91662, 91930-92126, 92356-92371, 93190-93443, 93762-94111, 94374-94389, 94581-94653, 94839-94858, 95292-95583, 95829-95844, 96137-96503, 96793-97013, 97539-97554, 97800-97889, 98132-98151, 98624-

98672, 98810-99115, 99258-99273, 99478-99503, 99791-99858, 100281-100300, 100406-100421, 100742-100828, 101080-101103, 101242-101320, 101788-101906, 102549-102568, 103566-103625, 104067-104086, 104277-104858, 105255-105274, 106147-106364, 106632-106647, 106964-107735, 108514-108788, 109336-109505, 109849-109864, 110403-110442, 110701-110974, 111203-111322, 112030-112049, 112499-112514, 112842-112861, 113028-113056, 113646-113665, 113896-113911, 114446-114465, 115087-115106, 119269-119284, 119659-119703, 120376-120497, 120738-120845, 121209-121228, 121823-122013, 122180-122199, 122588-122770, 123031-123050, 123152-123167, 123671-124055, 124413-124608, 125178-125197, 125533-125616, 126357-126434, 126736-126751, 126998-127236, 127454-127682, 128467-128482, 128813-129111, 129976-130013, 130308-130323, 131036-131056, 131286-131305, 131676-131691, 132171-132517, 133168-133241, 133522-133877, 134086-134101, 134240-134259, 134441-134617, 135015-135030, 135431-135519, 135818-135874, 136111-136130, 136282-136595, 136996-137152, 137372-137387, 137750-137765, 138048-138067, 138782-139840, 140343-140358, 140593-140701, 141116-141131, 141591-141719, 142113-142342, 143021-143048, 143185-143486, 143836-144109, 144558-144650, 144990-145078, 145428-145525, 145937-145952, 146235-146386, 147028-147043, 147259-147284, 147671-147686, 148059-148154, 148564-148579, 148904-149084, 149491-149506, 149787-149877, 150236-150251, 150588-151139, 151373-151659, 152201-152388, 152549-152771, 153001-153026, 153349-153364, 153831-154112, 154171-154186, 154502-154521, 154724-154828, 155283-155304, 155591-155616, 155889-155992, 156233-156612, 156847-156907, 157198-157223, 157330-157349, 157552-157567, 157927-158029, 158542-158631, 159216-159267, 159539-159793, 160352-160429, 160812-160827, 161248-161267, 161461-161607, 161821-161969, 162064-162083, 162132-162147, 162531-162770, 163019-163557, 164839-165059, 165419-165575, 165856-165875, 166241-166450, 166837-166852, 167107-167122, 168004-168019, 168760-168823, 169062-169092, 169134-169153, 169601-169711, 170081-170291, 170407-170426, 170703-170814, 171021-171036, 171207-171226, 171431-171568, 171926-171945, 172447-172462, 172733-172956, 173045-173756, 174122-174885, 175014-177830, 178895-180539, 181514-187644, 187857-189904, 190109-194159, 194425-195723, 196536-196873, 197326-197961, 198145-198170, 198307-198381, 198715-199007, 199506-199563, 199816-199838, 200249-200635, 201258-201861, 202079-202094, 202382-202717, 203098-203934, 204181-204740, 205549-205915, 206412-206764, 207510-207532, 209999-210014, 210189-210296, 210502-210583, 210920-211418, 211836-212223, 212606-212816, 213025-213044, 213425-213440, 213825-213933, 214479-214498, 214622-214647, 214884-214951, 215446-215508, 215932-215951, 216192-217595, 218132-218248, 218526-218541, 218734-21219037, 219342-219633, 219886-220705, 221044-221059, 221483-221607, 221947-221962, 222569-222584, 222914-222998, 223436-223451, 223948-224122, 224409-224430, 224717-224769, 225133-225148, 225436-225761, 226785-226898, 227025-227040, 227218-227251, 227485-227500, 227914-228837, 229174-229189, 229423-229438, 229615-229640, 230042-230057, 230313-230595, 231218-231345, 231817-232037, 232088-232408, 232823-232848, 232884-232899, 233210-233225, 233623-233646, 234447-234466, 234876-234918, 235258-235328, 235770-235785, 236071-236213, 236684-237196, 237585-237698, 237949-237557, 244873-244897, 245319-245334, 245701-245780, 246152-246523, 246936-247031, 247203-247240, 247431-247450, 247644-247659, 248223-248363, 248694-248762, 249494-249509, 250001-250020, 250693-250708, 251214-251233, 251601-251637, 251950-252060, 252665-252680, 252838-252863, 253140-253166, 253594-253819, 254036-254083, 254246-254345, 254641-254660, 254905-254920, 255397-255422, 255618-255633, 255992-256704, 257018-257092, 257317-257332, 257818-259305, 259500-259515, 261294-261656, 262021-262036, 262453-262779, 263338-266518, 266861-267131, 267375-268051, 268366-269447, 270038-271850, 271950-271969, 272631-274145, 274205-275747, 275808-276636, 276932-277064, 277391-278380, 278932-279063, 279303-281001, 281587-281610, 282229-283668, 290035-290474, 290924-292550, 292860-294408, 295475-297012, 297587-298115, 298161-298418, 298489-298738, 299082-299187, 299276-299669, 299723-299749, 299788-300504, or 300835-301295.

In certain embodiments, a compound comprises an antisense compound or oligonucleotide and a conjugate group, wherein the antisense compound or oligonucleotide is targeted to target intron 1 of a growth hormone receptor nucleic acid. In certain aspects, antisense compounds or oligonucleotides target within nucleotides 3058-144965 (intron 1) of a growth hormone receptor nucleic acid having the nucleobase sequence of SEQ ID NO: 2 (GENBANK Accession No. NT_006576.16 truncated from nucleotides 42411001 to 42714000).

In certain embodiments, a compound comprises an antisense compound or oligonucleotide and a conjugate group, wherein the antisense compound or oligonucleotide is targeted to intron 2 of a growth hormone receptor nucleic acid. In certain aspects, antisense compounds or oligonucleotides target within nucleotides 145047-208139 (intron 2) of a growth hormone receptor nucleic acid having the nucleobase sequence of SEQ ID NO: 2 (GENBANK Accession No. NT_006576.16 truncated from nucleotides 42411001 to 42714000).

In certain embodiments, a compound comprises an antisense compound or oligonucleotide and a conjugate group, wherein the antisense compound or oligonucleotide is targeted to intron 3 of a growth hormone receptor nucleic acid. In certain aspects, antisense compounds or oligonucleotides target within nucleotides 208206-267991 (intron 3) of a growth hormone receptor nucleic acid having the nucleobase sequence of SEQ ID NO: 2 (GENBANK Accession No. NT_006576.16 truncated from nucleotides 42411001 to 42714000).

In certain embodiments, a compound comprises an antisense compound or oligonucleotide and a conjugate group, wherein the antisense compound or oligonucleotide is targeted to intron 4 of a growth hormone receptor nucleic acid. In certain aspects, antisense compounds or oligonucleotides target within nucleotides 268122-274018 (intron 4) of a growth hormone receptor nucleic acid having the nucleobase sequence of SEQ ID NO: 2 (GENBANK Accession No. NT_006576.16 truncated from nucleotides 42411001 to 42714000).

In certain embodiments, a compound comprises an antisense compound or oligonucleotide and a conjugate group, wherein the antisense compound or oligonucleotide is targeted to intron 5 of a growth hormone receptor nucleic acid. In certain aspects, antisense compounds or oligonucleotides target within nucleotides 274192-278925 (intron 5) of a growth hormone receptor nucleic acid having the nucleobase sequence of SEQ ID NO: 2 (GENBANK Accession No. NT_006576.16 truncated from nucleotides 42411001 to 42714000).

In certain embodiments, a compound comprises an antisense compound or oligonucleotide and a conjugate group, wherein the antisense compound or oligonucleotide is targeted to intron 6 of a growth hormone receptor nucleic acid. In certain aspects, antisense compounds or oligonucleotides target within nucleotides 279105-290308 (intron 6) of a growth hormone receptor nucleic acid having the nucleobase sequence of SEQ ID NO: 2 (GENBANK Accession No. NT_006576.16 truncated from nucleotides 42411001 to 42714000).

In certain embodiments, a compound comprises an antisense compound or oligonucleotide and a conjugate group, wherein the antisense compound or oligonucleotide is targeted to intron 7 of a growth hormone receptor nucleic acid. In certain aspects, antisense compounds or oligonucleotides target within nucleotides 290475-292530 (intron 7) of a growth hormone receptor nucleic acid having the nucleobase sequence of SEQ ID NO: 2 (GENBANK Accession No. NT_006576.16 truncated from nucleotides 42411001 to 42714000).

In certain embodiments, a compound comprises an antisense compound or oligonucleotide and a conjugate group, wherein the antisense compound or oligonucleotide is targeted to intron 8 of a growth hormone receptor nucleic acid. In certain aspects, antisense compounds or oligonucleotides target within nucleotides 292622-297153 (intron 8) of a growth hormone receptor nucleic acid having the nucleobase sequence of SEQ ID NO: 2 (GENBANK Accession No. NT_006576.16 truncated from nucleotides 42411001 to 42714000).

In certain embodiments, a compound comprises an antisense compound or oligonucleotide and a conjugate group, wherein the antisense compound or oligonucleotide is targeted to intron 9 of a growth hormone receptor nucleic acid. In certain aspects, antisense compounds or oligonucleotides target within nucleotides 297224-297554 (intron 9) of a growth hormone receptor nucleic acid having the nucleobase sequence of SEQ ID NO: 2 (GENBANK Accession No. NT_006576.16 truncated from nucleotides 42411001 to 42714000).

In certain embodiments, any of the foregoing compounds or oligonucleotides comprises at least one modified internucleoside linkage, at least one modified sugar, and/or at least one modified nucleobase.

In certain embodiments, any of the foregoing compounds or oligonucleotides comprises at least one modified sugar. In certain aspects, at least one modified sugar comprises a 2'-O-methoxyethyl group. In certain aspects, at least one modified sugar is a bicyclic sugar, such as a 4'-CH(CH3)—O-2' group, a 4'-CH2—O-2' group, or a 4'-(CH2)2-O-2'group.

In certain aspects, the modified oligonucleotide comprises at least one modified internucleoside linkage, such as a phosphorothioate internucleoside linkage.

In certain embodiments, any of the foregoing compounds or oligonucleotides comprises at least one modified nucleobase, such as 5-methylcytosine.

In certain embodiments, any of the foregoing compounds or oligonucleotides comprises:
a gap segment consisting of linked deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar.

Certain embodiments provide a compound comprising a modified oligonucleotide consisting of 10 to 30 linked nucleosides having a nucleobase sequence comprising the sequence recited in SEQ ID NO: 918, 479, 703, 1800, 1904, 2122, 2127, or 2194.

In certain aspects, the modified oligonucleotide has a nucleobase sequence comprising the sequence recited in SEQ ID NOs: 918, 479 or 703, wherein the modified oligonucleotide comprises
a gap segment consisting of ten linked deoxynucleosides;
a 5' wing segment consisting of five linked nucleosides; and
a 3' wing segment consisting of five linked nucleosides;
wherein the gap segment is positioned between the 5' wing segment and the 3' wing segment, wherein each nucleoside of each wing segment comprises a 2'-O-methoxyethyl sugar; wherein each internucleoside linkage is a phosphorothioate linkage and wherein each cytosine is a 5-methylcytosine.

In certain aspects, the modified oligonucleotide has a nucleobase sequence comprising the sequence recited in SEQ ID NOs: 1800, 1904, 2122, 2127, or 2194, wherein the modified oligonucleotide comprises of nucleosides that have either a MOE sugar modification, an (S)-cEt sugar modification, or a deoxy modification; wherein each internucleoside linkage is a phosphorothioate linkage; and wherein each cytosine is a 5-methylcytosine.

In certain embodiments, a compound comprises a single-stranded modified oligonucleotide and a conjugate group, wherein the modified oligonucleotide consists of 20 linked nucleosides and has a nucleobase sequence comprising the sequence recited in SEQ ID NOs: 918, 479 or 703, wherein the modified oligonucleotide comprises
a gap segment consisting of ten linked deoxynucleosides;
a 5' wing segment consisting of five linked nucleosides; and
a 3' wing segment consisting of five linked nucleosides;
wherein the gap segment is positioned between the 5' wing segment and the 3' wing segment, wherein each nucleoside of each wing segment comprises a 2'-O-methoxyethyl sugar; wherein each internucleoside linkage is a phosphorothioate linkage and wherein each cytosine is a 5-methylcytosine.

In certain embodiments, a compound comprises a single-stranded modified oligonucleotide and a conjugate group, wherein the modified oligonucleotide consists of 16 linked nucleosides and has a nucleobase sequence comprising the sequence recited in SEQ ID NOs: 1800, 1904, 2122, 2127, or 2194, wherein the modified oligonucleotide comprises of nucleosides that have either a MOE sugar modification, an (S)-cEt sugar modification, or a deoxy modification; wherein each internucleoside linkage is a phosphorothioate linkage; and wherein each cytosine is a 5-methylcytosine.

In certain embodiments, a compound comprises an ISIS oligonucleotide targeting GHR and a conjugate group. For instance, in certain embodiments, a compound comprises ISIS 532401 and a conjugate group.

In any of the foregoing embodiments, the compound or oligonucleotide can be at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% complementary to a nucleic acid encoding growth hormone receptor.

In any of the foregoing embodiments, the nucleic acid encoding growth hormone receptor can comprise the nucleotide sequence of any one of SEQ ID NOs: 1-19.

In any of the foregoing embodiments, the compound or oligonucleotide can be single-stranded.

In any of the foregoing embodiments, the compound or oligonucleotide can be double-stranded.

In certain embodiments, at least one internucleoside linkage of the modified oligonucleotide is a modified internucleoside linkage.

In certain embodiments, at least one modified internucleoside linkage of the modified oligonucleotide is a phosphorothioate internucleoside linkage.

In certain embodiments, the modified oligonucleotide comprises at least 1, 2, 3, 4, 5, 6, or 7 phosphodiester internucleoside linkages.

In certain embodiments, each internucleoside linkage of the modified oligonucleotide is selected from a phosphodiester internucleoside linkage and a phosphorothioate internucleoside linkage.

In certain embodiments, each internucleoside linkage of the modified oligonucleotide is a phosphorothioate linkage.

In certain embodiments, at least one nucleoside of the modified oligonucleotide comprises a modified nucleobase.

In certain embodiments, the modified nucleobase is a 5-methylcytosine.

In certain embodiments, the modified oligonucleotide comprises at least one modified sugar.

In certain embodiments, the modified sugar is a 2' modified sugar, a BNA, or a THP.

In certain embodiments, the modified sugar is any of a 2'-O-methoxyethyl, 2'-O-methyl, a constrained ethyl, a LNA, or a 3'-fluoro-HNA.

In certain embodiments, the compound comprises at least one 2'-O-methoxyethyl nucleoside, 2'-O-methyl nucleoside, constrained ethyl nucleoside, LNA nucleoside, or 3'-fluoro-HNA nucleoside.

In certain embodiments, the modified oligonucleotide comprises:
a gap segment consisting of 10 linked deoxynucleosides;
a 5' wing segment consisting of 5 linked nucleosides; and
a 3' wing segment consisting of 5 linked nucleosides;
wherein the gap segment is positioned between the 5' wing segment and the 3' wing segment and wherein each nucleoside of each wing segment comprises a modified sugar.

In certain embodiments, the modified oligonucleotide consists of 20 linked nucleosides.

In certain embodiments, the modified oligonucleotide consists of 19 linked nucleosides.

In certain embodiments, the modified oligonucleotide consists of 18 linked nucleosides.

Certain embodiments provide compounds consisting of a conjugate group and a modified oligonucleotide (SEQ ID NO: 703) according to the following formula: mCes mCes Aes mCes mCes Tds Tds Tds Gds Gds Gds Tds Gds Ads Ads Tes Aes Ges mCes Ae; wherein,
A=an adenine,
mC =a 5-methylcytosine
G=a guanine,
T=a thymine,
e=a 2'-O-methoxyethyl modified nucleoside,
d=a 2'-deoxynucleoside, and
s=a phosphorothioate internucleoside linkage.

In certain embodiments, a compound comprises an ISIS oligonucleotide targeting GHR conjugated to GalNAc on the 5' end. For instance, in certain embodiments, a compound comprises ISIS 532401 conjugated to GalNAc on the 5' end. In further embodiments, the compound has the following chemical structure comprising or consisting of ISIS 532401 (SEQ ID NO: 703) with 5'-X, wherein X is a conjugate group comprising GalNAc as described herein:

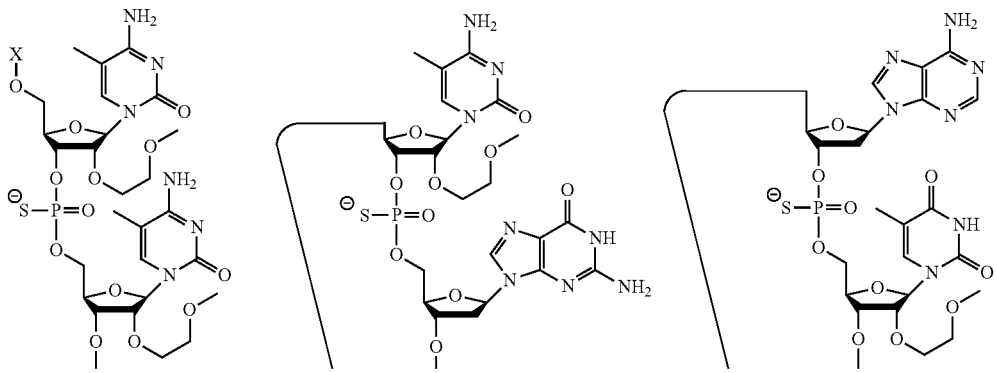

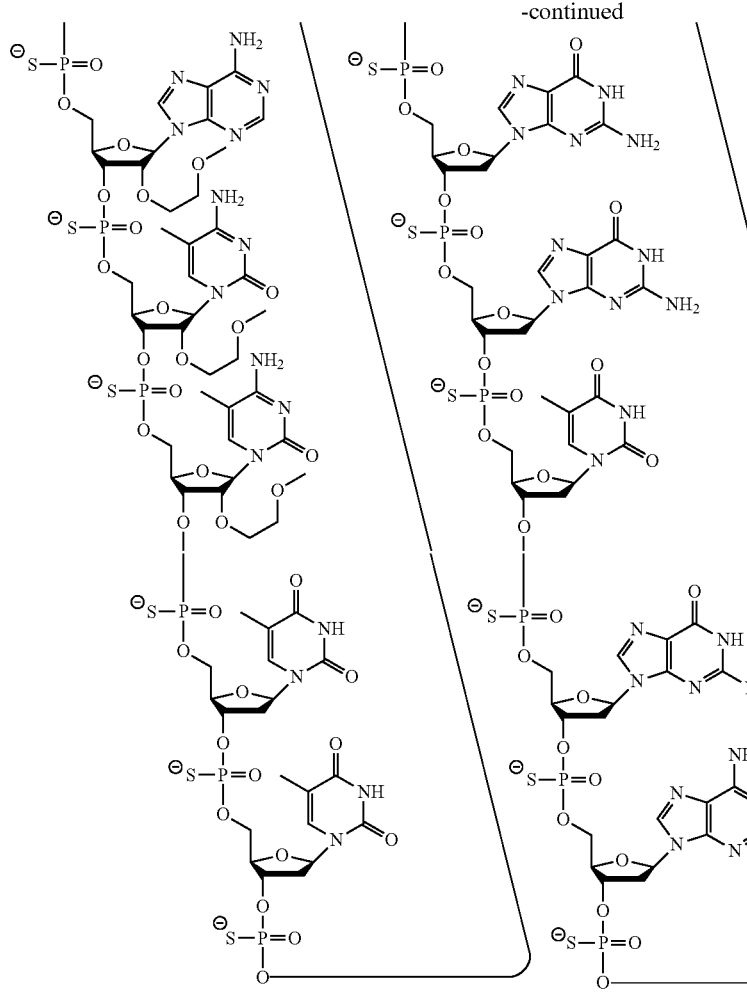
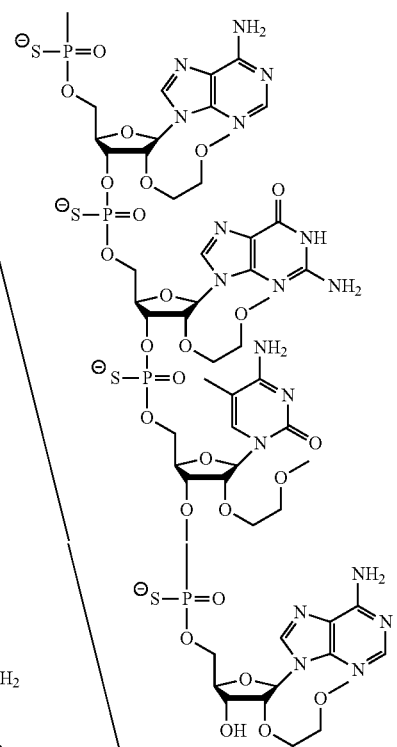

wherein X is a conjugate group comprising GalNAc.

In certain embodiments, a compound comprises an ISIS oligonucleotide targeting GHR conjugated to GalNAc, and wherein each internucleoside linkage of the oligonucleotide is a phosphorothioate linkage. In further embodiments, a compound having the following chemical structure comprises or consists of ISIS 719223 (SEQ ID NO: 703) with 5'-X, wherein X is a conjugate group comprising GalNAc as described herein:

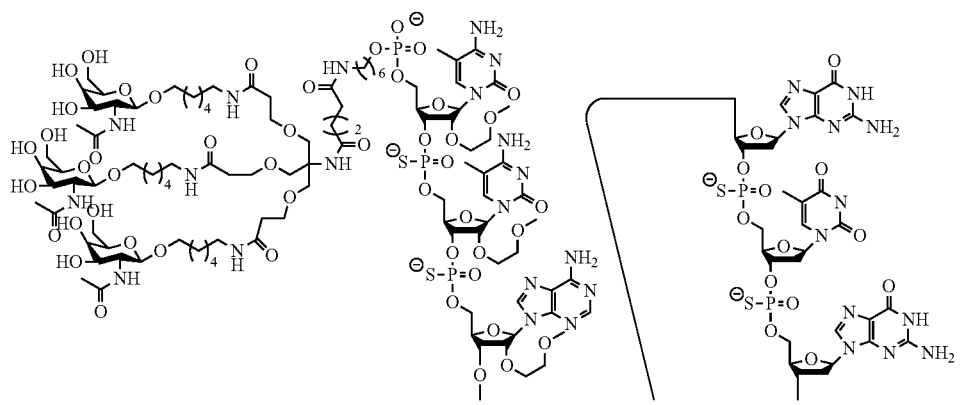

-continued

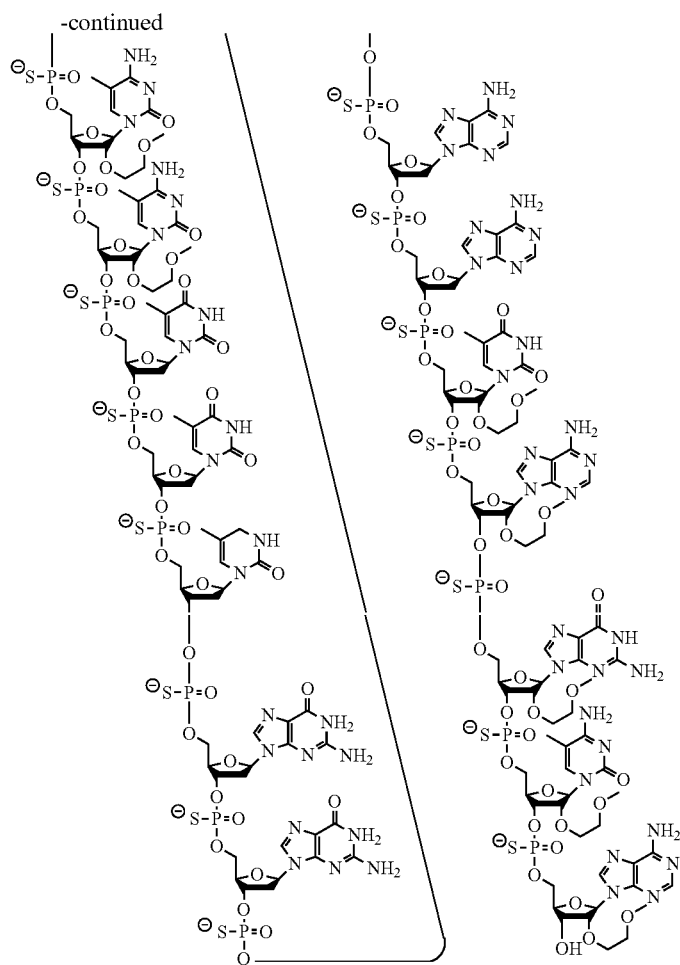

In certain embodiments, a compound comprises an ISIS oligonucleotide targeting GHR conjugated to GalNAc, and wherein each internucleoside linkage of the oligonucleotide is a phosphorothioate linkage or a phosphodiester linkage. In further embodiments, a compound having the following chemical structure comprises or consists of ISIS 719224 (SEQ ID NO: 703) with 5'-X, wherein X is a conjugate group comprising GalNAc as described herein:

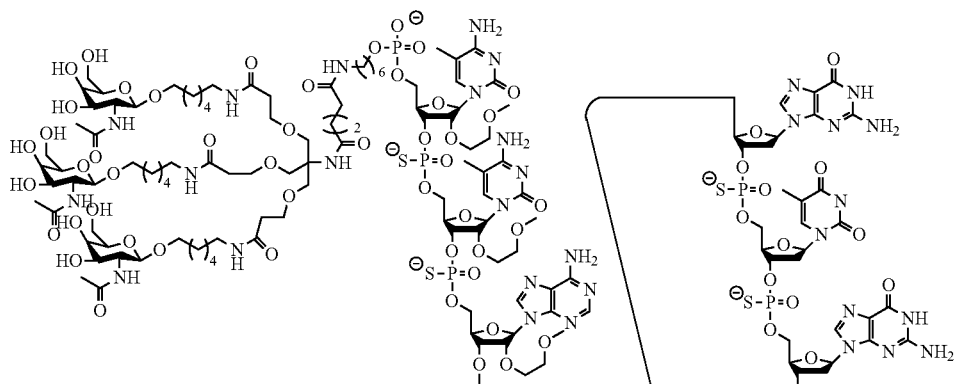

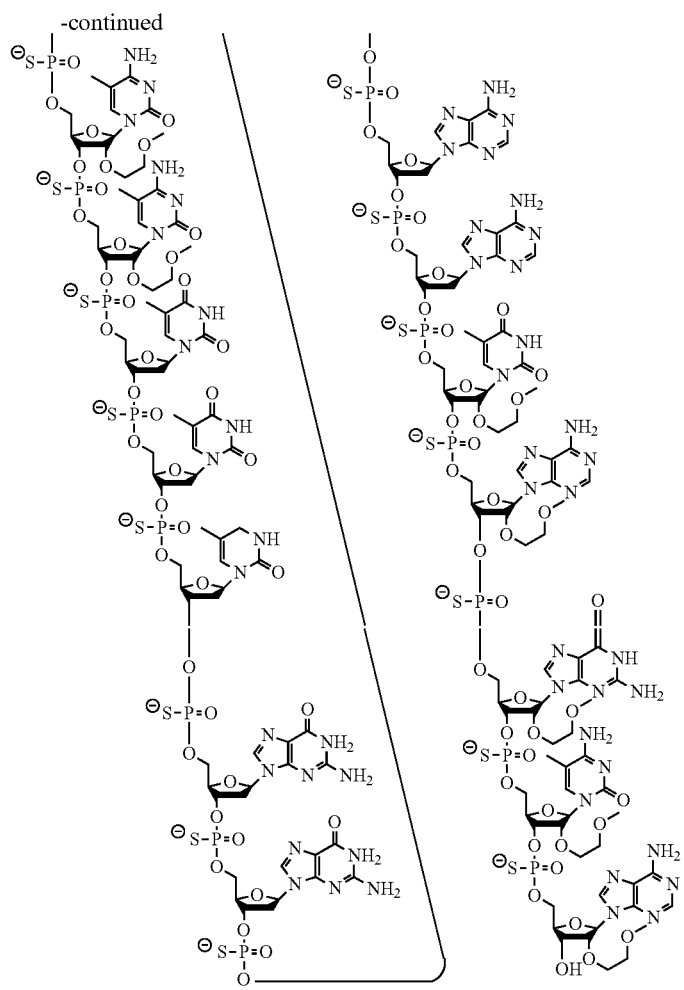

In certain embodiments, a compound comprises an ISIS oligonucleotide targeting GHR conjugated to GalNAc, and wherein each internucleoside linkage of the oligonucleotide is a phosphorothioate linkage or a phosphodiester linkage. In further embodiments, a compound having the following chemical structure comprises or consists of ISIS 766720 (SEQ ID NO: 703) with 5'-X, wherein X is a conjugate group comprising GalNAc as described herein:

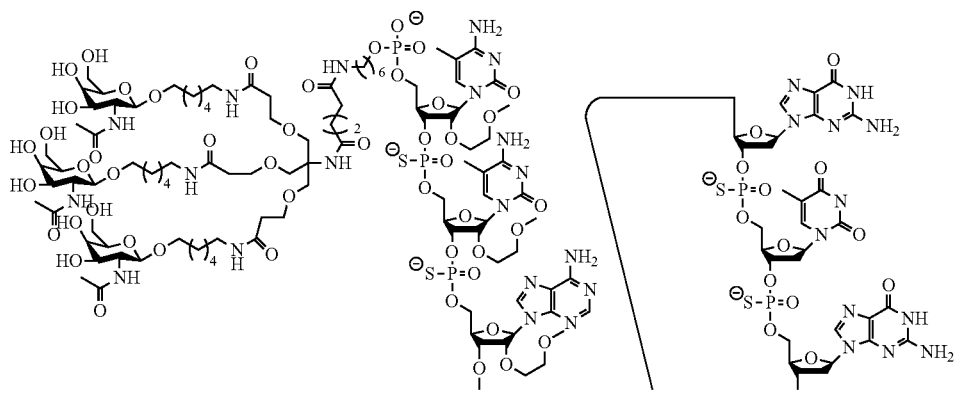

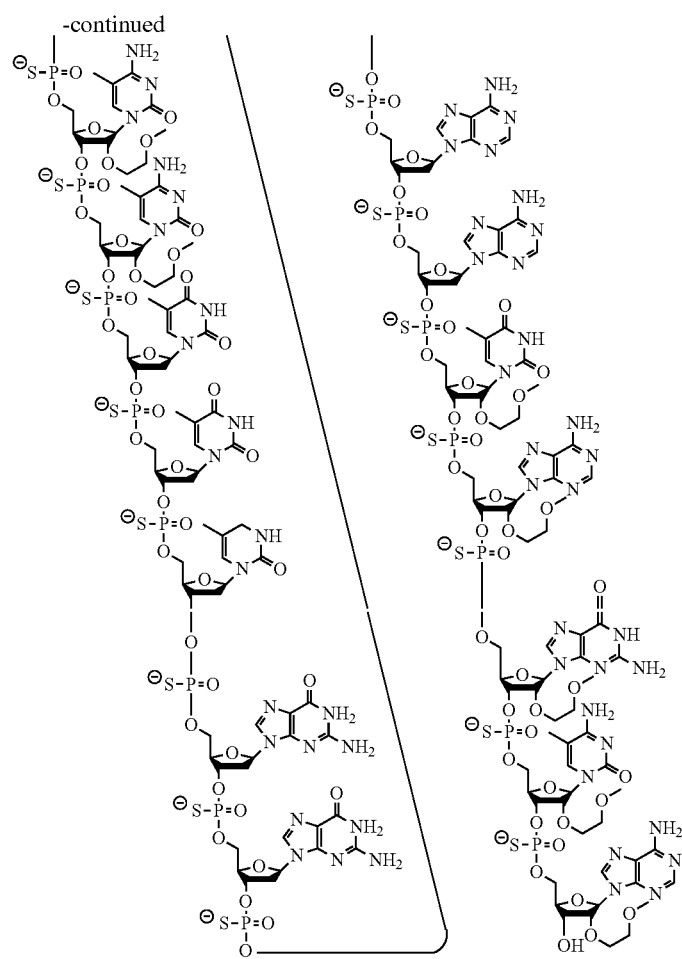
In certain embodiments, a compound comprises an ISIS oligonucleotide targeting GHR conjugated to GalNAc. In further such embodiments, the compound comprises the sequence of ISIS 532401 (SEQ ID NO: 703) conjugated to GalNAc, and is represented by the following chemical structure:
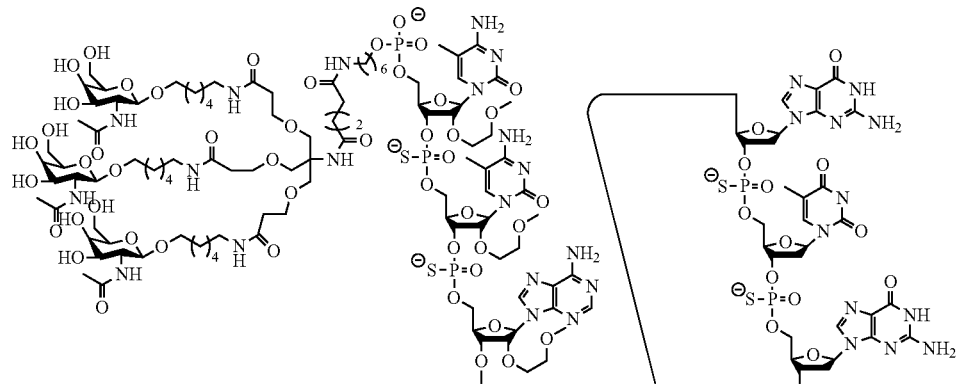

-continued

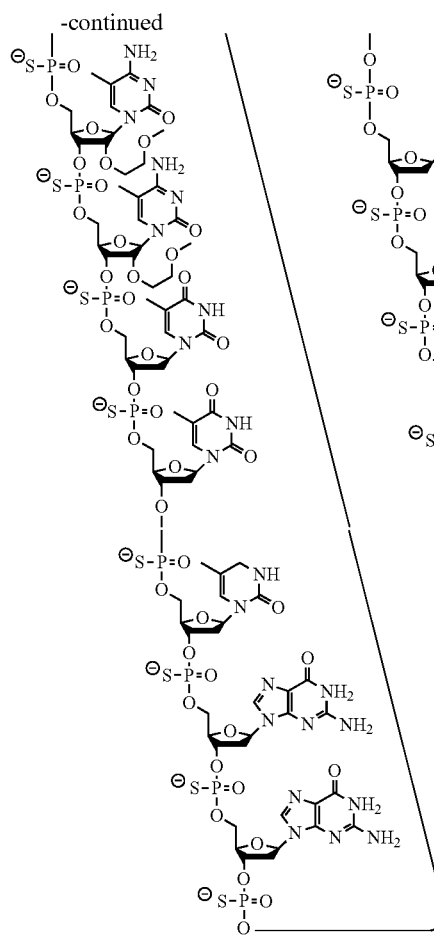

wherein either $R^1$ is —OCH$_2$CH$_2$OCH$_3$ (MOE) and $R^2$ is H; or $R^1$ and $R^2$ together form a bridge, wherein $R^1$ is —O— and $R^2$ is —CH$_2$—, —CH(CH$_3$)—, or —CH$_2$CH$_2$—, and $R^1$ and $R^2$ are directly connected such that the resulting bridge is selected from: —O—CH$_2$—, —O—CH(CH$_3$)—, and —O—CH$_2$CH$_2$—; and for each pair of $R^3$ and $R^4$ on the same ring, independently for each ring: either $R^3$ is selected from H and —OCH$_2$CH$_2$OCH$_3$ and $R^4$ is H; or $R^3$ and $R^4$ together form a bridge, wherein $R^3$ is —O—, and $R^4$ is —CH$_2$—, —CH(CH$_3$)—, or —CH$_2$CH$_2$— and $R^3$ and $R^4$ are directly connected such that the resulting bridge is selected from: —O—CH$_2$—, —O—CH(CH$_3$)—, and —O—CH$_2$CH$_2$—; and $R^5$ is selected from H and —CH$_3$; and Z is selected from S$^-$ and O$^-$.

In certain embodiments, a compound comprises an antisense oligonucleotide having a nucleobase sequence of any of SEQ ID NOs disclosed in WO 2004/078922 and a conjugate group described herein. The nucleobase sequences of all of the aforementioned referenced SEQ ID NOs are incorporated by reference herein. For example, a compound comprises an oligonucleotide (SEQ ID NO: 2336) disclosed in WO 2004/078922 conjugated to GalNAc, and wherein each internucleoside linkage of the oligonucleotide is a phosphorothioate linkage and has the following chemical structure:

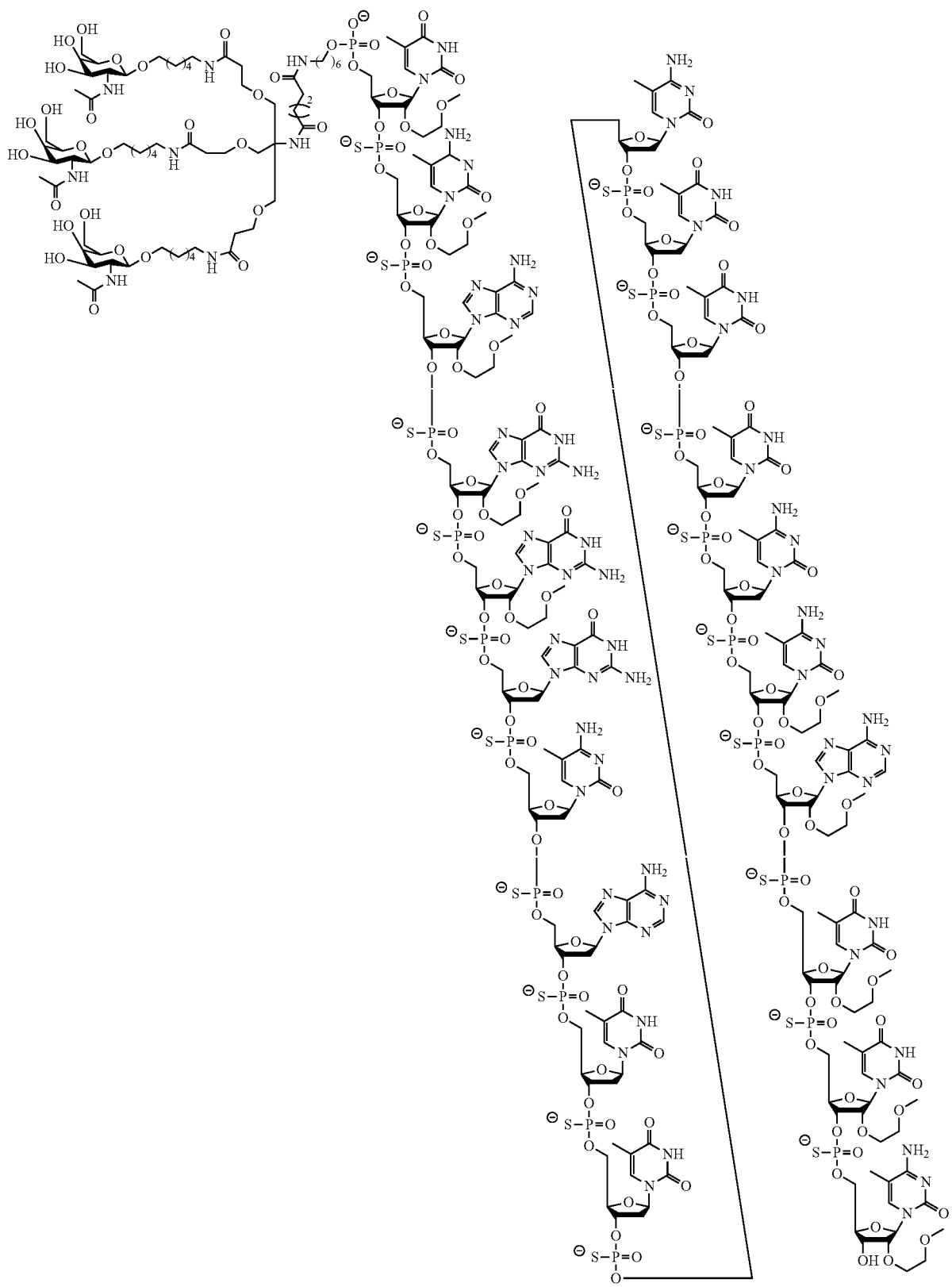
For example, a compound comprises an oligonucleotide (SEQ ID NO: 2336) disclosed in WO 2004/078922 conjugated to GalNAc, and wherein each internucleoside linkage of the oligonucleotide is a phosphorothioate linkage or a phosphodiester linkage, and has the following chemical structure:

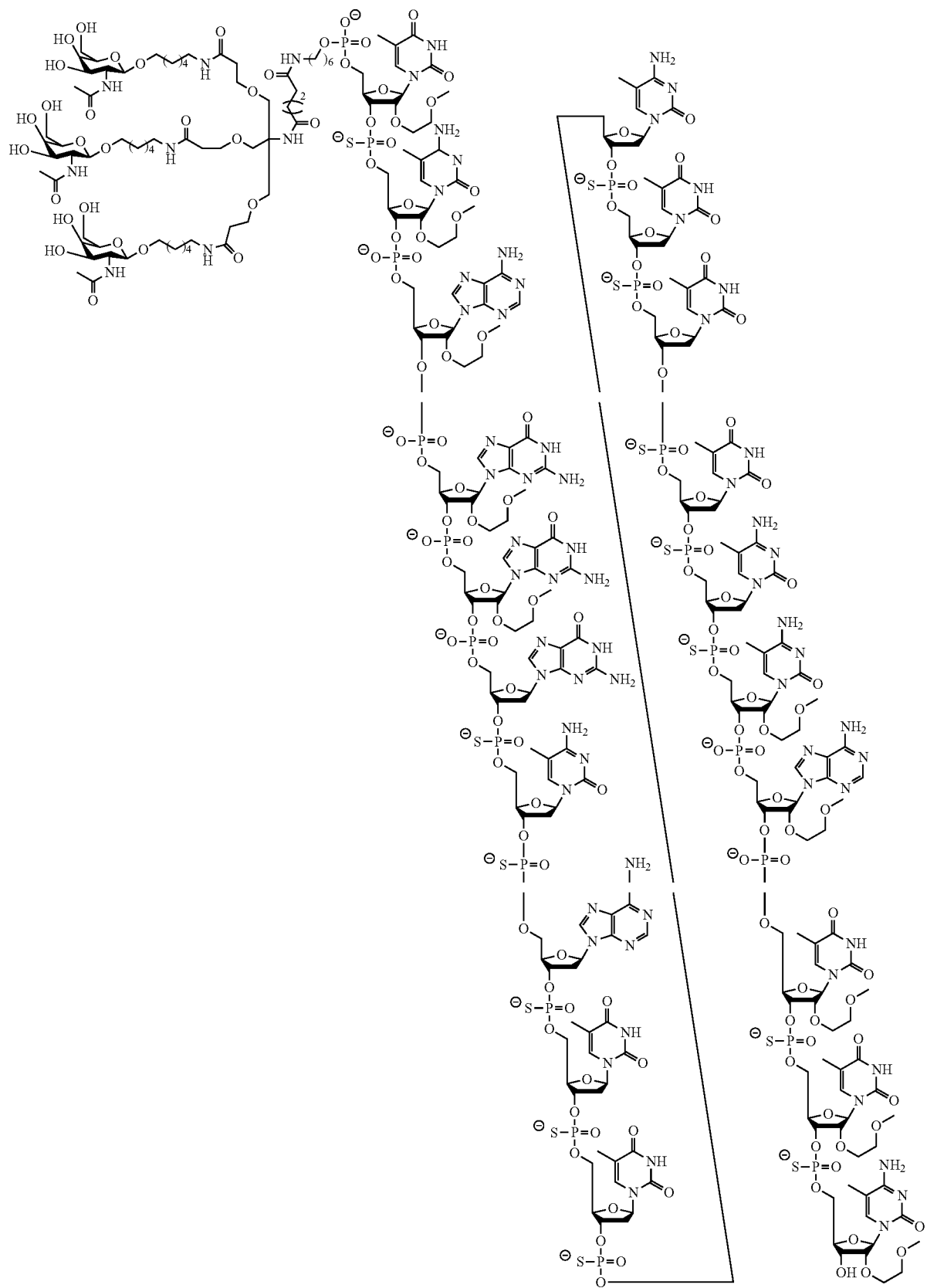

Certain embodiments provide a composition comprising the compound of any of the aforementioned embodiments or salt thereof and at least one of a pharmaceutically acceptable carrier or diluent. In certain aspects, the composition has a viscosity less than about 40 centipoise (cP), less than about 30 centipose (cP), less than about 20 centipose (cP), less than about 15 centipose (cP), or less than about 10 centipose (cP). In certain aspects, the composition having any of the aforementioned viscosities comprises a compound provided herein at a concentration of about 100 mg/mL, about 125 mg/mL, about 150 mg/mL, about 175 mg/mL, about 200 mg/mL, about 225 mg/mL, about 250 mg/mL, about 275 mg/mL, or about 300 mg/mL. In certain aspects, the composition having any of the aforementioned viscosities and/or compound concentrations has a temperature of room temperature or about 20° C., about 21° C., about 22° C., about 23° C., about 24° C., about 25° C., about 26° C., about 27° C., about 28° C., about 29° C., or about 30° C.

Certain embodiments provide a method of treating a disease associated with excess growth hormone in a human comprising administering to the human a therapeutically effective amount of the compound or composition of any of the aforementioned embodiments, thereby treating the disease associated with excess growth hormone. In certain aspects, the disease associated with excess growth hormone is acromegaly. In certain aspects, the treatment reduces IGF-1 levels.

Certain embodiments provide a method of preventing a disease associated with excess growth hormone in a human comprising administering to the human a therapeutically effective amount of a compound or composition of any of the aforementioned embodiments, thereby preventing the disease associated with excess growth hormone. In certain embodiments, the disease associated with excess growth hormone is acromegaly.

Certain embodiments provide a method of reducing growth hormone receptor (GHR) levels in a human comprising administering to the human a therapeutically effective amount of the compound or composition of any of the aforementioned embodiments, thereby reducing GHR levels in the human. In certain aspects, the human has a disease associated with excess growth hormone. In certain aspects, the disease associated with excess growth hormone is acromegaly.

In certain aspects, the foregoing methods comprise co-administering the compound or composition and a second agent. In certain aspects, the compound or composition and the second agent are administered concomitantly.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound may be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments, an antisense compound is 10 to 30 subunits in length. In certain embodiments, an antisense compound is 12 to 30 subunits in length. In certain embodiments, an antisense compound is 12 to 22 subunits in length. In certain embodiments, an antisense compound is 14 to 30 subunits in length. In certain embodiments, an antisense compound is 14 to 20 subunits in length. In certain embodiments, an antisense compound is 15 to 30 subunits in length. In certain embodiments, an antisense compound is 15 to 20 subunits in length. In certain embodiments, an antisense compound is 16 to 30 subunits in length. In certain embodiments, an antisense compound is 16 to 20 subunits in length. In certain embodiments, an antisense compound is 17 to 30 subunits in length. In certain embodiments, an antisense compound is 17 to 20 subunits in length. In certain embodiments, an antisense compound is 18 to 30 subunits in length. In certain embodiments, an antisense compound is 18 to 21 subunits in length. In certain embodiments, an antisense compound is 18 to 20 subunits in length. In certain embodiments, an antisense compound is 20 to 30 subunits in length. In other words, such antisense compounds are from 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits, respectively. In certain embodiments, an antisense compound is 14 subunits in length. In certain embodiments, an antisense compound is 16 subunits in length. In certain embodiments, an antisense compound is 17 subunits in length. In certain embodiments, an antisense compound is 18 subunits in length. In certain embodiments, an antisense compound is 19 subunits in length. In certain embodiments, an antisense compound is 20 subunits in length. In other embodiments, the antisense compound is 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the antisense compounds are 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In some embodiments the antisense compound is an antisense oligonucleotide, and the linked subunits are nucleotides.

In certain embodiments antisense oligonucleotides may be shortened or truncated. For example, a single subunit may be deleted from the 5' end (5' truncation), or alternatively from the 3' end (3' truncation). A shortened or truncated antisense compound targeted to a GHR nucleic acid may have two subunits deleted from the 5' end, or alternatively may have two subunits deleted from the 3' end, of the antisense compound. Alternatively, the deleted nucleosides may be dispersed throughout the antisense compound, for example, in an antisense compound having one nucleoside deleted from the 5' end and one nucleoside deleted from the 3' end.

When a single additional subunit is present in a lengthened antisense compound, the additional subunit may be located at the 5' or 3' end of the antisense compound. When two or more additional subunits are present, the added subunits may be adjacent to each other, for example, in an antisense compound having two subunits added to the 5' end (5' addition), or alternatively to the 3' end (3' addition), of the antisense compound. Alternatively, the added subunits may be dispersed throughout the antisense compound, for example, in an antisense compound having one subunit added to the 5' end and one subunit added to the 3' end.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al. (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (Nuc. Acid. Res. 16:3341-3358, 1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Certain Antisense Compound Motifs and Mechanisms

In certain embodiments, antisense compounds have chemically modified subunits arranged in patterns, or motifs, to confer to the antisense compounds properties such as enhanced inhibitory activity, increased binding affinity for a target nucleic acid, or resistance to degradation by in vivo nucleases.

Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may confer another desired property e.g., serve as a substrate for the cellular endonuclease RNase H, which cleaves the RNA strand of an RNA:DNA duplex.

Antisense activity may result from any mechanism involving the hybridization of the antisense compound (e.g., oligonucleotide) with a target nucleic acid, wherein the hybridization ultimately results in a biological effect. In certain embodiments, the amount and/or activity of the target nucleic acid is modulated. In certain embodiments, the amount and/or activity of the target nucleic acid is reduced. In certain embodiments, hybridization of the antisense compound to the target nucleic acid ultimately results in target nucleic acid degradation. In certain embodiments, hybridization of the antisense compound to the target nucleic acid does not result in target nucleic acid degradation. In certain such embodiments, the presence of the antisense compound hybridized with the target nucleic acid (occupancy) results in a modulation of antisense activity. In certain embodiments, antisense compounds having a particular chemical motif or pattern of chemical modifications are particularly suited to exploit one or more mechanisms. In certain embodiments, antisense compounds function through more than one mechanism and/or through mechanisms that have not been elucidated. Accordingly, the antisense compounds described herein are not limited by particular mechanism.

Antisense mechanisms include, without limitation, RNase H mediated antisense; RNAi mechanisms, which utilize the RISC pathway and include, without limitation, siRNA, ssRNA and microRNA mechanisms; and occupancy based mechanisms. Certain antisense compounds may act through more than one such mechanism and/or through additional mechanisms.

RNase H-Mediated Antisense

In certain embodiments, antisense activity results at least in part from degradation of target RNA by RNase H. RNase H is a cellular endonuclease that cleaves the RNA strand of an RNA:DNA duplex. It is known in the art that single-stranded antisense compounds which are "DNA-like" elicit RNase H activity in mammalian cells. Accordingly, antisense compounds comprising at least a portion of DNA or DNA-like nucleosides may activate RNase H, resulting in cleavage of the target nucleic acid. In certain embodiments, antisense compounds that utilize RNase H comprise one or more modified nucleosides. In certain embodiments, such antisense compounds comprise at least one block of 1-8 modified nucleosides. In certain such embodiments, the modified nucleosides do not support RNase H activity. In certain embodiments, such antisense compounds are gapmers, as described herein. In certain such embodiments, the gap of the gapmer comprises DNA nucleosides. In certain such embodiments, the gap of the gapmer comprises DNA-like nucleosides. In certain such embodiments, the gap of the gapmer comprises DNA nucleosides and DNA-like nucleosides.

Certain antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may in some embodiments include β-D-ribonucleosides, β-D-deoxyribonucleosides, 2'-modified nucleosides (such 2'-modified nucleosides may include 2'-MOE and 2'-O—CH$_3$, among others), and bicyclic sugar modified nucleosides (such bicyclic sugar modified nucleosides may include those having a constrained ethyl). In certain embodiments, nucleosides in the wings may include several modified sugar moieties, including, for example 2'-MOE and bicyclic sugar moieties such as constrained ethyl or LNA. In certain embodiments, wings may include several modified and unmodified sugar moieties. In certain embodiments, wings may include various combinations of 2'-MOE nucleosides, bicyclic sugar moieties such as constrained ethyl nucleosides or LNA nucleosides, and 2'-deoxynucleosides.

Each distinct region may comprise uniform sugar moieties, variant, or alternating sugar moieties. The wing-gap-wing motif is frequently described as "X—Y—Z", where "X" represents the length of the 5'-wing, "Y" represents the length of the gap, and "Z" represents the length of the 3'-wing. "X" and "Z" may comprise uniform, variant, or alternating sugar moieties. In certain embodiments, "X" and "Y" may include one or more 2'-deoxynucleosides. "Y" may comprise 2'-deoxynucleosides. As used herein, a gapmer described as "X—Y—Z" has a configuration such that the gap is positioned immediately adjacent to each of the 5'-wing and the 3' wing. Thus, no intervening nucleotides exist between the 5'-wing and gap, or the gap and the 3'-wing. Any of the antisense compounds described herein can have a gapmer motif. In certain embodiments, "X" and "Z" are the same; in other embodiments they are different. In certain embodiments, "Y" is between 8 and 15 nucleosides. X, Y, or Z can be any of 1, 2, 3, 4, 5, 6, 7, 8, 9, 10, 11, 12, 13, 14, 15, 16, 17, 18, 19, 20, 25, 30 or more nucleosides.

In certain embodiments, the antisense compound targeted to a GHR nucleic acid has a gapmer motif in which the gap consists of 6, 7, 8, 9, 10, 11, 12, 13, 14, 15, or 16 linked nucleosides.

In certain embodiments, the antisense oligonucleotide has a sugar motif described by Formula A as follows:
$(J)_m\text{-}(B)_n\text{-}(J)_p\text{-}(B)_r\text{-}(A)_t\text{-}(D)_g\text{-}(A)_v\text{-}(B)_w\text{-}(J)_x\text{-}(B)_y\text{-}(J)_z$
wherein:
each A is independently a 2'-substituted nucleoside;
each B is independently a bicyclic nucleoside;
each J is independently either a 2'-substituted nucleoside or a 2'-deoxynucleoside;
each D is a 2'-deoxynucleoside;
m is 0-4; n is 0-2; p is 0-2; r is 0-2; t is 0-2; v is 0-2; w is 0-4; x is 0-2; y is 0-2; z is 0-4; g is 6-14;
provided that:
at least one of m, n, and r is other than 0;
at least one of w and y is other than 0;
the sum of m, n, p, r, and t is from 2 to 5; and
the sum of v, w, x, y, and z is from 2 to 5.

RNAi Compounds

In certain embodiments, antisense compounds are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). In certain embodiments, antisense compounds comprise modifications that make them particularly suited for such mechanisms.

i. ssRNA Compounds

In certain embodiments, antisense compounds including those particularly suited for use as single-stranded RNAi compounds (ssRNA) comprise a modified 5'-terminal end. In certain such embodiments, the 5'-terminal end comprises a modified phosphate moiety. In certain embodiments, such modified phosphate is stabilized (e.g., resistant to degradation/cleavage compared to unmodified 5'-phosphate). In certain embodiments, such 5'-terminal nucleosides stabilize the 5'-phosphorous moiety. Certain modified 5'-terminal nucleosides may be found in the art, for example in WO/2011/139702.

In certain embodiments, the 5'-nucleoside of an ssRNA compound has Formula IIc:

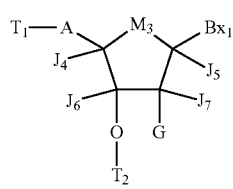

wherein:
$T_1$ is an optionally protected phosphorus moiety;
$T_2$ is an internucleoside linking group linking the compound of Formula IIc to the oligomeric compound;
A has one of the formulas:

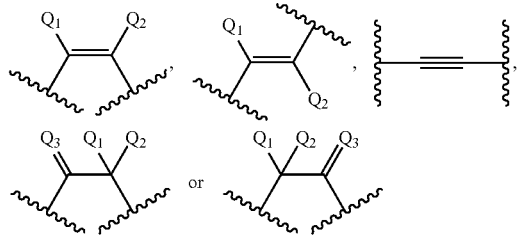

$Q_1$ and $Q_2$ are each, independently, H, halogen, $C_1\text{-}C_6$ alkyl, substituted $C_1\text{-}C_6$ alkyl, $C_1\text{-}C_6$ alkoxy, substituted $C_1\text{-}C_6$ alkoxy, $C_2\text{-}C_6$ alkenyl, substituted $C_2\text{-}C_6$ alkenyl, $C_2\text{-}C_6$ alkynyl, substituted $C_2\text{-}C_6$ alkynyl or $N(R_3)(R_4)$;
$Q_3$ is O, S, $N(R_5)$ or $C(R_6)(R_7)$;
each $R_3$, $R_4$ $R_5$, $R_6$ and $R_7$ is, independently, H, $C_1\text{-}C_6$ alkyl, substituted $C_1\text{-}C_6$ alkyl or $C_1\text{-}C_6$ alkoxy;
$M_3$ is O, S, $NR_{14}$, $C(R_{15})(R_{16})$, $C(R_{15})(R_{16})C(R_{17})(R_{18})$, $C(R_{15})\text{=}C(R_{17})$, $OC(R_{15})(R_{16})$ or $OC(R_{15})(Bx_2)$;
$R_{14}$ is H, $C_1\text{-}C_6$ alkyl, substituted $C_1\text{-}C_6$ alkyl, $C_1\text{-}C_6$ alkoxy, substituted $C_1\text{-}C_6$ alkoxy, $C_2\text{-}C_6$ alkenyl, substituted $C_2\text{-}C_6$ alkenyl, $C_2\text{-}C_6$ alkynyl or substituted $C_2\text{-}C_6$ alkynyl;
$R_{15}$, $R_{16}$, $R_{17}$ and $R_{18}$ are each, independently, H, halogen, $C_1\text{-}C_6$ alkyl, substituted $C_1\text{-}C_6$ alkyl, $C_1\text{-}C_6$ alkoxy, substituted $C_1\text{-}C_6$ alkoxy, $C_2\text{-}C_6$ alkenyl, substituted $C_2\text{-}C_6$ alkenyl, $C_2\text{-}C_6$ alkynyl or substituted $C_2\text{-}C_6$ alkynyl;
$Bx_1$ is a heterocyclic base moiety;
or if $Bx_2$ is present then $Bx_2$ is a heterocyclic base moiety and $Bx_1$ is H, halogen, $C_1\text{-}C_6$ alkyl, substituted $C_1\text{-}C_6$ alkyl, $C_1\text{-}C_6$ alkoxy, substituted $C_1\text{-}C_6$ alkoxy, $C_2\text{-}C_6$ alkenyl, substituted $C_2\text{-}C_6$ alkenyl, $C_2\text{-}C_6$ alkynyl or substituted $C_2\text{-}C_6$ alkynyl;
$J_4$, $J_5$, $J_6$ and $J_7$ are each, independently, H, halogen, $C_1\text{-}C_6$ alkyl, substituted $C_1\text{-}C_6$ alkyl, $C_1\text{-}C_6$ alkoxy, substituted $C_1\text{-}C_6$ alkoxy, $C_2\text{-}C_6$ alkenyl, substituted $C_2\text{-}C_6$ alkenyl, $C_2\text{-}C_6$ alkynyl or substituted $C_2\text{-}C_6$ alkynyl;
or $J_4$ forms a bridge with one of $J_5$ or $J_7$ wherein said bridge comprises from 1 to 3 linked biradical groups selected from O, S, $NR_{19}$, $C(R_{20})(R_{21})$, $C(R_{20})\text{=}C(R_{21})$, $C[\text{=}C(R_{20})(R_{21})]$ and $C(\text{=}O)$ and the other two of $J_5$, $J_6$ and $J_7$ are each, independently, H, halogen, $C_1\text{-}C_6$ alkyl, substituted $C_1\text{-}C_6$ alkyl, $C_1\text{-}C_6$ alkoxy, substituted $C_1\text{-}C_6$ alkoxy, $C_2\text{-}C_6$ alkenyl, substituted $C_2\text{-}C_6$ alkenyl, $C_2\text{-}C_6$ alkynyl or substituted $C_2\text{-}C_6$ alkynyl;
each $R_{19}$, $R_{20}$ and $R_{21}$ is, independently, H, $C_1\text{-}C_6$ alkyl, substituted $C_1\text{-}C_6$ alkyl, $C_1\text{-}C_6$ alkoxy, substituted $C_1\text{-}C_6$ alkoxy, $C_2\text{-}C_6$ alkenyl, substituted $C_2\text{-}C_6$ alkenyl, $C_2\text{-}C_6$ alkynyl or substituted $C_2\text{-}C_6$ alkynyl;
G is H, OH, halogen or $O\text{—}[C(R_8)(R_9)]_n\text{—}[(C\text{=}O)_m\text{—}X_1]_j\text{—}Z$;
each $R_8$ and $R_9$ is, independently, H, halogen, $C_1\text{-}C_6$ alkyl or substituted $C_1\text{-}C_6$ alkyl;
$X_1$ is O, S or $N(E_1)$;
Z is H, halogen, $C_1\text{-}C_6$ alkyl, substituted $C_1\text{-}C_6$ alkyl, $C_2\text{-}C_6$ alkenyl, substituted $C_2\text{-}C_6$ alkenyl, $C_2\text{-}C_6$ alkynyl, substituted $C_2\text{-}C_6$ alkynyl or $N(E_2)(E_3)$;
$E_1$, $E_2$ and $E_3$ are each, independently, H, $C_1\text{-}C_6$ alkyl or substituted $C_1\text{-}C_6$ alkyl;
n is from 1 to about 6;

m is 0 or 1;

j is 0 or 1;

each substituted group comprises one or more optionally protected substituent groups independently selected from halogen, $OJ_1$, $N(J_1)(J_2)$, $=NJ_1$, $SJ_1$, $N_3$, CN, $OC(=X_2)J_1$, $OC(=X_2)N(J_1)(J_2)$ and $C(=X_2)N(J_1)(J_2)$;

$X_2$ is O, S or $NJ_3$;

each $J_1$, $J_2$ and $J_3$ is, independently, H or $C_1$-$C_6$ alkyl;

when j is 1 then Z is other than halogen or $N(E_2)(E_3)$; and wherein said oligomeric compound comprises from 8 to 40 monomeric subunits and is hybridizable to at least a portion of a target nucleic acid.

In certain embodiments, $M_3$ is O, CH=CH, $OCH_2$ or $OC(H)(Bx_2)$. In certain embodiments, $M_3$ is O.

In certain embodiments, $J_4$, $J_5$, $J_6$ and $J_7$ are each H. In certain embodiments, $J_4$ forms a bridge with one of $J_5$ or $J_7$.

In certain embodiments, A has one of the formulas:

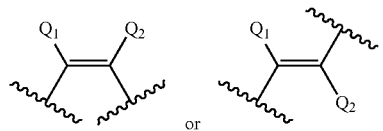

wherein:

$Q_1$ and $Q_2$ are each, independently, H, halogen, $C_1$-$C_6$ alkyl, substituted $C_1$-$C_6$ alkyl, $C_1$-$C_6$ alkoxy or substituted $C_1$-$C_6$ alkoxy. In certain embodiments, $Q_1$ and $Q_2$ are each H. In certain embodiments, $Q_1$ and $Q_2$ are each, independently, H or halogen. In certain embodiments, $Q_1$ and $Q_2$ is H and the other of $Q_1$ and $Q_2$ is F, $CH_3$ or $OCH_3$.

In certain embodiments, $T_1$ has the formula:

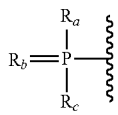

wherein:

$R_a$ and $R_c$ are each, independently, protected hydroxyl, protected thiol, $C_1$-$C_6$ alkyl, substituted $C_1$-$C_6$ alkyl, $C_1$-$C_6$ alkoxy, substituted $C_1$-$C_6$ alkoxy, protected amino or substituted amino; and $R_b$ is O or S. In certain embodiments, $R_b$ is O and $R_a$ and $R_c$ are each, independently, $OCH_3$, $OCH_2CH_3$ or $CH(CH_3)_2$.

In certain embodiments, G is halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2$—CH=$CH_2$, $O(CH_2)_2$—$OCH_3$, $O(CH_2)_2$—$SCH_3$, $O(CH_2)_2$—$OCF_3$, $O(CH_2)_3$—$N(R_{10})(R_{11})$, $O(CH_2)_2$—$ON(R_{10})(R_{11})$, $O(CH_2)_2$—$O(CH_2)_2$—$N(R_{10})(R_{11})$, $OCH_2C(=O)$—$N(R_{10})(R_{11})$, $OCH_2C(=O)$—$N(R_{12})$—$(CH_2)_2$—$N(R_{10})(R_{11})$ or $O(CH_2)_2$—$N(R_{12})$—$C(=NR_{13})[N(R_{10})(R_{11})]$ wherein $R_{10}$, $R_{11}$, $R_{12}$ and $R_{13}$ are each, independently, H or $C_1$-$C_6$ alkyl. In certain embodiments, G is halogen, $OCH_3$, $OCF_3$, $OCH_2CH_3$, $OCH_2CF_3$, $OCH_2$—CH=$CH_2$, $O(CH_2)_2$—$OCH_3$, $O(CH_2)_2$—$O(CH_2)_2$—$N(CH_3)_2$, $OCH_2C(=O)$—$N(H)CH_3$, $OCH_2C(=O)$—$N(H)$—$(CH_2)_2$—$N(CH_3)_2$ or $OCH_2$—$N(H)$—$C(=NH)NH_2$. In certain embodiments, G is F, $OCH_3$ or $O(CH_2)_2$—$OCH_3$. In certain embodiments, G is $O(CH_2)_2$—$OCH_3$.

In certain embodiments, the 5'-terminal nucleoside has Formula IIe:

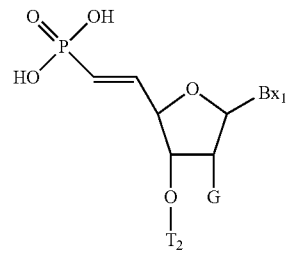

In certain embodiments, antisense compounds, including those particularly suitable for ssRNA comprise one or more type of modified sugar moieties and/or naturally occurring sugar moieties arranged along an oligonucleotide or region thereof in a defined pattern or sugar modification motif. Such motifs may include any of the sugar modifications discussed herein and/or other known sugar modifications.

In certain embodiments, the oligonucleotides comprise or consist of a region having uniform sugar modifications. In certain such embodiments, each nucleoside of the region comprises the same RNA-like sugar modification. In certain embodiments, each nucleoside of the region is a 2'-F nucleoside. In certain embodiments, each nucleoside of the region is a 2'-OMe nucleoside. In certain embodiments, each nucleoside of the region is a 2'-MOE nucleoside. In certain embodiments, each nucleoside of the region is a cEt nucleoside. In certain embodiments, each nucleoside of the region is an LNA nucleoside. In certain embodiments, the uniform region constitutes all or essentially all of the oligonucleotide. In certain embodiments, the region constitutes the entire oligonucleotide except for 1-4 terminal nucleosides.

In certain embodiments, oligonucleotides comprise one or more regions of alternating sugar modifications, wherein the nucleosides alternate between nucleotides having a sugar modification of a first type and nucleotides having a sugar modification of a second type. In certain embodiments, nucleosides of both types are RNA-like nucleosides. In certain embodiments the alternating nucleosides are selected from: 2'-OMe, 2'-F, 2'-MOE, LNA, and cEt. In certain embodiments, the alternating modifications are 2'-F and 2'-OMe. Such regions may be contiguous or may be interrupted by differently modified nucleosides or conjugated nucleosides.

In certain embodiments, the alternating region of alternating modifications each consist of a single nucleoside (i.e., the pattern is $(AB)_xA_y$ wherein A is a nucleoside having a sugar modification of a first type and B is a nucleoside having a sugar modification of a second type; x is 1-20 and y is 0 or 1). In certain embodiments, one or more alternating regions in an alternating motif includes more than a single nucleoside of a type. For example, oligonucleotides may include one or more regions of any of the following nucleoside motifs:

AABBAA;
ABBABB;
AABAAB;
ABBABAABB;
ABABAA;
AABABAB;
ABABAA;
ABBAABBABABAA;
BABBAABBABABAA; or
ABABBAABBABABAA;

wherein A is a nucleoside of a first type and B is a nucleoside of a second type. In certain embodiments, A and B are each selected from 2'-F, 2'-OMe, BNA, and MOE.

In certain embodiments, oligonucleotides having such an alternating motif also comprise a modified 5' terminal nucleoside, such as those of formula IIc or IIe.

In certain embodiments, oligonucleotides comprise a region having a 2-2-3 motif. Such regions comprises the following motif:

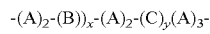

wherein: A is a first type of modified nucleoside;
B and C, are nucleosides that are differently modified than A, however, B and C may have the same or different modifications as one another;
x and y are from 1 to 15.

In certain embodiments, A is a 2'-OMe modified nucleoside. In certain embodiments, B and C are both 2'-F modified nucleosides. In certain embodiments, A is a 2'-OMe modified nucleoside and B and C are both 2'-F modified nucleosides.

In certain embodiments, oligonucleosides have the following sugar motif:

$5'\text{-}(Q)\text{-}(AB)_x A_y\text{-}(D)_z$ wherein:
Q is a nucleoside comprising a stabilized phosphate moiety. In certain embodiments, Q is a nucleoside having Formula IIc or IIe;
A is a first type of modified nucleoside;
B is a second type of modified nucleoside;
D is a modified nucleoside comprising a modification different from the nucleoside adjacent to it. Thus, if y is 0, then D must be differently modified than B and if y is 1, then D must be differently modified than A. In certain embodiments, D differs from both A and B.
X is 5-15;
Y is 0 or 1;
Z is 0-4.

In certain embodiments, oligonucleosides have the following sugar motif:

$5'\text{-}(Q)\text{-}(A)_x\text{-}(D)_z$ wherein:
Q is a nucleoside comprising a stabilized phosphate moiety. In certain embodiments, Q is a nucleoside having Formula IIc or He;
A is a first type of modified nucleoside;
D is a modified nucleoside comprising a modification different from A.
X is 11-30;
Z is 0-4.

In certain embodiments A, B, C, and D in the above motifs are selected from: 2'-OMe, 2'-F, 2'-MOE, LNA, and cEt. In certain embodiments, D represents terminal nucleosides. In certain embodiments, such terminal nucleosides are not designed to hybridize to the target nucleic acid (though one or more might hybridize by chance). In certain embodiments, the nucleobase of each D nucleoside is adenine, regardless of the identity of the nucleobase at the corresponding position of the target nucleic acid. In certain embodiments the nucleobase of each D nucleoside is thymine.

In certain embodiments, antisense compounds, including those particularly suited for use as ssRNA comprise modified internucleoside linkages arranged along the oligonucleotide or region thereof in a defined pattern or modified internucleoside linkage motif. In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate internucleoside linkages. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least one block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

Oligonucleotides having any of the various sugar motifs described herein, may have any linkage motif. For example, the oligonucleotides, including but not limited to those described above, may have a linkage motif selected from non-limiting the table below:

| 5' most linkage | Central region | 3'-region |
|---|---|---|
| PS | Alternating PO/PS | 6 PS |
| PS | Alternating PO/PS | 7 PS |
| PS | Alternating PO/PS | 8 PS | ii. siRNA Compounds

In certain embodiments, antisense compounds are double-stranded RNAi compounds (siRNA). In such embodiments, one or both strands may comprise any modification motif described above for ssRNA. In certain embodiments, ssRNA compounds may be unmodified RNA. In certain embodiments, siRNA compounds may comprise unmodified RNA nucleosides, but modified internucleoside linkages.

Several embodiments relate to double-stranded compositions wherein each strand comprises a motif defined by the location of one or more modified or unmodified nucleosides. In certain embodiments, compositions are provided comprising a first and a second oligomeric compound that are fully or at least partially hybridized to form a duplex region and further comprising a region that is complementary to and hybridizes to a nucleic acid target. It is suitable that such a composition comprise a first oligomeric compound that is an antisense strand having full or partial complementarity to a nucleic acid target and a second oligomeric compound that is a sense strand having one or more regions of complementarity to and forming at least one duplex region with the first oligomeric compound.

The compositions of several embodiments modulate gene expression by hybridizing to a nucleic acid target resulting in loss of its normal function. In some embodiments, the target nucleic acid is GHR. In certain embodiment, the degradation of the targeted GHR is facilitated by an activated RISC complex that is formed with compositions of the invention.

Several embodiments are directed to double-stranded compositions wherein one of the strands is useful in, for example, influencing the preferential loading of the opposite strand into the RISC (or cleavage) complex. The compositions are useful for targeting selected nucleic acid molecules and modulating the expression of one or more genes. In some embodiments, the compositions of the present invention hybridize to a portion of a target RNA resulting in loss of normal function of the target RNA.

Certain embodiments are drawn to double-stranded compositions wherein both the strands comprises a hemimer motif, a fully modified motif, a positionally modified motif or an alternating motif. Each strand of the compositions of the present invention can be modified to fulfil a particular role in for example the siRNA pathway. Using a different motif in each strand or the same motif with different chemical modifications in each strand permits targeting the antisense strand for the RISC complex while inhibiting the incorporation of the sense strand. Within this model, each strand can be independently modified such that it is enhanced for its particular role. The antisense strand can be modified at the 5'-end to enhance its role in one region of the RISC while the 3'-end can be modified differentially to enhance its role in a different region of the RISC.

The double-stranded oligonucleotide molecules can be a double-stranded polynucleotide molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. The double-stranded oligonucleotide molecules can be assembled from two separate oligonucleotides, where one strand is the sense strand and the other is the antisense strand, wherein the antisense and sense strands are self-complementary (i.e. each strand comprises nucleotide sequence that is complementary to nucleotide sequence in the other strand; such as where the antisense strand and sense strand form a duplex or double-stranded structure, for example wherein the double-stranded region is about 15 to about 30, e.g., about 15, 16, 17, 18, 19, 20, 21, 22, 23, 24, 25, 26, 27, 28, 29 or 30 base pairs; the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof (e.g., about 15 to about 25 or more nucleotides of the double-stranded oligonucleotide molecule are complementary to the target nucleic acid or a portion thereof). Alternatively, the double-stranded oligonucleotide is assembled from a single oligonucleotide, where the self-complementary sense and antisense regions of the siRNA are linked by means of a nucleic acid based or non-nucleic acid-based linker(s).

The double-stranded oligonucleotide can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The double-stranded oligonucleotide can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siRNA molecule capable of mediating RNAi.

In certain embodiments, the double-stranded oligonucleotide comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the double-stranded oligonucleotide comprises nucleotide sequence that is complementary to nucleotide sequence of a target gene. In another embodiment, the double-stranded oligonucleotide interacts with nucleotide sequence of a target gene in a manner that causes inhibition of expression of the target gene.

As used herein, double-stranded oligonucleotides need not be limited to those molecules containing only RNA, but further encompasses chemically modified nucleotides and non-nucleotides. In certain embodiments, the short interfering nucleic acid molecules lack 2'-hydroxy (2'-OH) containing nucleotides. In certain embodiments short interfering nucleic acids optionally do not include any ribonucleotides (e.g., nucleotides having a 2'-OH group). Such double-stranded oligonucleotides that do not require the presence of ribonucleotides within the molecule to support RNAi can however have an attached linker or linkers or other attached or associated groups, moieties, or chains containing one or more nucleotides with 2'-OH groups.

Optionally, double-stranded oligonucleotides can comprise ribonucleotides at about 5, 10, 20, 30, 40, or 50% of the nucleotide positions. As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptg-sRNA), and others. In addition, as used herein, the term RNAi is meant to be equivalent to other terms used to describe sequence specific RNA interference, such as post transcriptional gene silencing, translational inhibition, or epigenetics. For example, double-stranded oligonucleotides can be used to epigenetically silence genes at both the post-transcriptional level and the pre-transcriptional level. In a non-limiting example, epigenetic regulation of gene expression by siRNA molecules of the invention can result from siRNA mediated modification of chromatin structure or methylation pattern to alter gene expression (see, for example, Verdel et al., 2004, Science, 303, 672-676; Pal- Bhadra et al., 2004, Science, 303, 669-672; Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237).

It is contemplated that compounds and compositions of several embodiments provided herein can target GHR by a dsRNA-mediated gene silencing or RNAi mechanism, including, e.g., "hairpin" or stem-loop double-stranded RNA effector molecules in which a single RNA strand with self-complementary sequences is capable of assuming a double-stranded conformation, or duplex dsRNA effector molecules comprising two separate strands of RNA. In various embodiments, the dsRNA consists entirely of ribonucleotides or consists of a mixture of ribonucleotides and deoxynucleotides, such as the RNA/DNA hybrids disclosed, for example, by WO 00/63364, filed Apr. 19, 2000, or U.S. Ser. No. 60/130,377, filed Apr. 21, 1999. The dsRNA or dsRNA effector molecule may be a single molecule with a region of self-complementarity such that nucleotides in one segment of the molecule base pair with nucleotides in another segment of the molecule. In various embodiments, a dsRNA that consists of a single molecule consists entirely of ribonucleotides or includes a region of ribonucleotides that is complementary to a region of deoxyribonucleotides. Alternatively, the dsRNA may include two different strands that have a region of complementarity to each other.

In various embodiments, both strands consist entirely of ribonucleotides, one strand consists entirely of ribonucleotides and one strand consists entirely of deoxyribonucleotides, or one or both strands contain a mixture of ribonucleotides and deoxyribonucleotides. In certain embodiments, the regions of complementarity are at least 70, 80, 90, 95, 98, or 100% complementary to each other and to a target nucleic acid sequence. In certain embodiments, the region of the dsRNA that is present in a double-stranded conformation includes at least 19, 20, 21, 22, 23, 24, 25, 26, 27, 28, 29, 30, 50, 75, 100, 200, 500, 1000, 2000 or 5000 nucleotides or includes all of the nucleotides in a cDNA or other target nucleic acid sequence being represented in the dsRNA. In some embodiments, the dsRNA does not contain any single stranded regions, such as single stranded ends, or the dsRNA is a hairpin. In other embodiments, the dsRNA has one or more single stranded regions or overhangs. In certain embodiments, RNA/DNA hybrids include a DNA strand or region that is an antisense strand or region (e.g, has at least 70, 80, 90, 95, 98, or 100% complementarity to a target nucleic acid) and an RNA strand or region that is a sense strand or region (e.g, has at least 70, 80, 90, 95, 98, or 100% identity to a target nucleic acid), and vice versa.

In various embodiments, the RNA/DNA hybrid is made in vitro using enzymatic or chemical synthetic methods such as those described herein or those described in WO 00/63364, filed Apr. 19, 2000, or U.S. Ser. No. 60/130,377, filed Apr. 21, 1999. In other embodiments, a DNA strand synthesized in vitro is complexed with an RNA strand made in vivo or in vitro before, after, or concurrent with the transformation of the DNA strand into the cell. In yet other embodiments, the dsRNA is a single circular nucleic acid containing a sense and an antisense region, or the dsRNA includes a circular nucleic acid and either a second circular nucleic acid or a linear nucleic acid (see, for example, WO 00/63364, filed Apr. 19, 2000, or U.S. Ser. No. 60/130,377, filed Apr. 21, 1999.) Exemplary circular nucleic acids include lariat structures in which the free 5' phosphoryl group of a nucleotide becomes linked to the 2' hydroxyl group of another nucleotide in a loop back fashion.

In other embodiments, the dsRNA includes one or more modified nucleotides in which the 2' position in the sugar contains a halogen (such as fluorine group) or contains an alkoxy group (such as a methoxy group) which increases the half-life of the dsRNA in vitro or in vivo compared to the corresponding dsRNA in which the corresponding 2' position contains a hydrogen or an hydroxyl group. In yet other embodiments, the dsRNA includes one or more linkages between adjacent nucleotides other than a naturally-occurring phosphodiester linkage. Examples of such linkages include phosphoramide, phosphorothioate, and phosphorodithioate linkages. The dsRNAs may also be chemically modified nucleic acid molecules as taught in U.S. Pat. No. 6,673,661. In other embodiments, the dsRNA contains one or two capped strands, as disclosed, for example, by WO 00/63364, filed Apr. 19, 2000, or U.S. Ser. No. 60/130,377, filed Apr. 21, 1999.

In other embodiments, the dsRNA can be any of the at least partially dsRNA molecules disclosed in WO 00/63364, as well as any of the dsRNA molecules described in U.S. Provisional Application 60/399,998; and U.S. Provisional Application 60/419,532, and PCT/US2003/033466, published on Apr. 29, 2004 as WO 2004/035765, the teaching of which is hereby incorporated by reference. Any of the dsRNAs may be expressed in vitro or in vivo using the methods described herein or standard methods, such as those described in WO 00/63364.

Occupancy

In certain embodiments, antisense compounds are not expected to result in cleavage or the target nucleic acid via RNase H or to result in cleavage or sequestration through the RISC pathway. In certain such embodiments, antisense activity may result from occupancy, wherein the presence of the hybridized antisense compound disrupts the activity of the target nucleic acid. In certain such embodiments, the antisense compound may be uniformly modified or may comprise a mix of modifications and/or modified and unmodified nucleosides.

Target Nucleic Acids, Target Regions and Nucleotide Sequences

Nucleotide sequences that encode growth hormone receptor (GHR) targetable with the compounds provided herein include, without limitation, the following: GENBANK Accession No. NM_000163.4 (incorporated herein as SEQ ID NO: 1), GENBANK Accession No. NT_006576.16 truncated from nucleotides 42411001 to 42714000 (incorporated herein as SEQ ID NO: 2), GENBANK Accession No X06562.1 (incorporated herein as SEQ ID NO: 3), GENBANK Accession No. DR006395.1 (incorporated herein as SEQ ID NO: 4), GENBANK Accession No. DB052048.1 (incorporated herein as SEQ ID NO: 5), GENBANK Accession No. AF230800.1 (incorporated herein as SEQ ID NO: 6), the complement of GENBANK Accession No. AA398260.1 (incorporated herein as SEQ ID NO: 7), GENBANK Accession No. BC136496.1 (incorporated herein as SEQ ID NO: 8), GENBANK Accession No. NM_001242399.2 (incorporated herein as SEQ ID NO: 9), GENBANK Accession No. NM_001242400.2 (incorporated herein as SEQ ID NO: 10), GENBANK Accession No. NM_001242401.3 (incorporated herein as SEQ ID NO: 11), GENBANK Accession No. NM_001242402.2 (incorporated herein as SEQ ID NO: 12), GENBANK Accession No. NM_001242403.2 (incorporated herein as SEQ ID NO: 13), GENBANK Accession No. NM_001242404.2 (incorporated herein as SEQ ID NO: 14), GENBANK Accession No. NM_001242405.2 (incorporated herein as SEQ ID NO: 15), GENBANK Accession No. NM_001242406.2 (incorporated herein as SEQ ID NO: 16), GENBANK Accession No. NM_001242460.1 (incorporated herein as SEQ ID NO: 17), GENBANK Accession NM_001242461.1 (incorporated herein as SEQ ID NO: 18), GENBANK Accession No. NM_001242462.1 (incorporated herein as SEQ ID NO: 19), or GENBANK Accession No NW_001120958.1 truncated from nucleotides 4410000 to U.S. Pat. No. 4,720,000 (incorporated herein as SEQ ID NO: 2332).

Hybridization

In some embodiments, hybridization occurs between an antisense compound disclosed herein and a GHR nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art. In certain embodiments, the antisense compounds provided herein are specifically hybridizable with a GHR nucleic acid.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as a GHR nucleic acid).

Non-complementary nucleobases between an antisense compound and a GHR nucleic acid may be tolerated provided that the antisense compound remains able to specifically hybridize to a target nucleic acid. Moreover, an antisense compound may hybridize over one or more segments of a GHR nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 80%, 85%, 86%, 87%, 88%, 89%, 90%, 91%, 92%, 93%, 94%, 95%, 96%, 97%, 98%, 99%, or 100% complementary to a GHR nucleic acid, a target region, target segment, or specified portion thereof. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having four non-complementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656).

Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, an antisense compound may be fully complementary to a GHR nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound may or may not be fully complementary to the target sequence, depending on whether the remaining 10 nucleobases of the antisense compound are also complementary to the target sequence.

The location of a non-complementary nucleobase may be at the 5' end or 3' end of the antisense compound. Alternatively, the non-complementary nucleobase or nucleobases may be at an internal position of the antisense compound. When two or more non-complementary nucleobases are present, they may be contiguous (i.e. linked) or non-contiguous. In one embodiment, a non-complementary nucleobase is located in the wing segment of a gapmer antisense oligonucleotide.

In certain embodiments, antisense compounds that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a GHR nucleic acid, or specified portion thereof.

In certain embodiments, antisense compounds that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a GHR nucleic acid, or specified portion thereof.

The antisense compounds provided also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 9 nucleobase portion of a target segment. In certain embodiments, the antisense compounds are complementary to at least a 10 nucleobase portion of a target segment. In certain embodiments, the antisense compounds are complementary to at least an 11 nucleobase portion of a target segment. In certain embodiments, the antisense compounds are complementary to at least a 12 nucleobase portion of a target segment. In certain embodiments, the antisense compounds are complementary to at least a 13 nucleobase portion of a target segment. In certain embodiments, the antisense compounds are complementary to at least a 14 nucleobase portion of a target segment. In certain embodiments, the antisense compounds are complementary to at least a 15 nucleobase portion of a target segment. Also contemplated are antisense compounds that are complementary to at least a 9, 10, 11, 12, 13, 14, 15, 16, 17, 18, 19, 20, or more nucleobase portion of a target segment, or a range defined by any two of these values.

Identity

The antisense compounds provided herein may also have a defined percent identity to a particular nucleotide sequence, SEQ ID NO, or compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases may be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are at least 70%, 75%, 80%, 85%, 90%, 95%, 96%, 97%, 98%, 99% or 100% identical to one or more of the antisense compounds or SEQ ID NOs, or a portion thereof, disclosed herein.

In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, a portion of the antisense oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides may also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to a GHR nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif. In certain embodiments, oligonucleotides of the present invention comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosponate linkages. In certain embodiments, oligonucleotides having a gapmer nucleoside motif comprise a linkage motif comprising all phosphorothioate linkages except for one or two methylphosponate linkages. In certain embodiments, one methylphosponate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

Modified Sugar Moieties

Antisense compounds can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise chemically modified ribofuranose ring moieties. Examples of chemically modified ribofuranose rings include without limitation, addition of substituent groups (including 5' and 2' substituent groups, bridging of non-geminal ring atoms to form bicyclic nucleic acids (BNA), replacement of the ribosyl ring oxygen atom with S, N(R), or $C(R_1)(R_2)$ (R, $R_1$ and $R_2$ are each independently H, $C_1$-$C_{12}$ alkyl or a protecting group) and combinations thereof. Examples of chemically modified sugars include 2'-F-5'-methyl substituted nucleoside (see PCT International Application WO 2008/101157 Published on Aug. 21, 2008 for other disclosed 5',2'-bis substituted nucleosides) or replacement of the ribosyl ring oxygen atom with S with further substitution at the 2'-position (see published U.S. Patent Application US2005-0130923, published on Jun. 16, 2005) or alternatively 5'-substitution of a BNA (see PCT International Application WO 2007/134181 Published on Nov. 22, 2007 wherein LNA is substituted with for example a 5'-methyl or a 5'-vinyl group).

Examples of nucleosides having modified sugar moieties include without limitation nucleosides comprising 5'-vinyl, 5'-methyl (R or S), 4'-S, 2'-F, 2'-$OCH_3$, 2'-$OCH_2CH_3$, 2'-$OCH_2CH_2F$ and 2'-$O(CH_2)_2OCH_3$ substituent groups. The substituent at the 2' position can also be selected from allyl, amino, azido, thio, O-allyl, O—$C_1$-$C_{10}$ alkyl, $OCF_3$, $OCH_2F$, $O(CH_2)_2SCH_3$, $O(CH_2)_2$—O—N($R_m$)($R_n$), O—$CH_2$—C(=O)—N($R_m$)($R_n$), and O—$CH_2$—C(=O)—N(R)—$(CH_2)_2$—N($R_m$)($R_n$), where each $R_j$, $R_m$ and $R_n$ is, independently, H or substituted or unsubstituted $C_1$-$C_{10}$ alkyl.

As used herein, "bicyclic nucleosides" refer to modified nucleosides comprising a bicyclic sugar moiety. Examples of bicyclic nucleosides include without limitation nucleosides comprising a bridge between the 4' and the 2' ribosyl ring atoms. In certain embodiments, antisense compounds provided herein include one or more bicyclic nucleosides comprising a 4' to 2' bridge. Examples of such 4' to 2' bridged bicyclic nucleosides, include but are not limited to one of the formulae: 4'-($CH_2$)—O-2' (LNA); 4'-($CH_2$)—S-2'; 4'-($CH_2$)$_2$—O-2' (ENA); 4'-CH($CH_3$)—O-2' (also referred to as constrained ethyl or cEt) and 4'-CH($CH_2OCH_3$)—O2' (and analogs thereof see U.S. Pat. No. 7,399,845, issued on Jul. 15, 2008); 4'-C($CH_3$)($CH_3$)—O-2' (and analogs thereof see published International Application WO/2009/006478, published Jan. 8, 2009); 4'-$CH_2$—N($OCH_3$)-2' (and analogs thereof see published International Application WO/2008/150729, published Dec. 11, 2008); 4'-$CH_2$—O—N($CH_3$)-2' (see published U.S. Patent Application US2004-0171570, published Sep. 2, 2004); 4'-$CH_2$—N(R)—O-2', wherein R is H, $C_1$-$C_{12}$ alkyl, or a protecting group (see U.S. Pat. No. 7,427,672, issued on Sep. 23, 2008); 4'-$CH_2$—C(H)($CH_3$)-2' (see Zhou et al., *J. Org. Chem.*, 2009, 74, 118-134); and 4'-$CH_2$—C(=$CH_2$)-2' (and analogs thereof see published International Application WO 2008/154401, published on Dec. 8, 2008).

Further reports related to bicyclic nucleosides can also be found in published literature (see for example: Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129(26) 8362-8379; Elayadi et al., *Curr. Opinion Invest. Drugs*, 2001, 2, 558-561; Braasch et al., *Chem. Biol.*, 2001, 8, 1-7; and Orum et al., *Curr. Opinion Mol. Ther.*, 2001, 3, 239-243; U.S. Pat. Nos. 6,268,490; 6,525,191; 6,670,461; 6,770,748; 6,794,499; 7,034,133; 7,053,207; 7,399,845; 7,547,684; and 7,696,345; U.S. Patent Publication No. US2008-0039618; US2009-0012281; U.S. Patent Serial Nos. 61/026,995 and 61/097,787; Published PCT International applications WO 1999/014226; WO 2004/106356; WO 2005/021570; WO 2007/134181; WO 2008/150729; WO 2008/154401; WO 2009/006478; WO 2010/036698; WO 2011/017521; WO 2009/067647; WO 20009/100320. Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

In certain embodiments, bicyclic sugar moieties of BNA nucleosides include, but are not limited to, compounds having at least one bridge between the 4' and the 2' position of the pentofuranosyl sugar moiety wherein such bridges independently comprises 1 or from 2 to 4 linked groups independently selected from —[C($R_a$)($R_b$)]$_n$—, —C($R_a$)=C($R_b$)—, —C($R_a$)=N—, —C(=O)—, —C(=N$R_a$)—, —C(=S)—, —O—, —Si($R_a$)$_2$—, —S(=O)$_x$—, and —N($R_a$)—;

wherein:

x is 0, 1, or 2;

n is 1, 2, 3, or 4;

each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl or a protecting group.

In certain embodiments, the bridge of a bicyclic sugar moiety is —[C($R_a$)($R_b$)]$_n$—, —[C($R_a$)($R_b$)]$_n$—O—, —C($R_aR_b$)—N(R)—O— or —C($R_aR_b$)—O—N(R)—. In certain embodiments, the bridge is 4'-CH$_2$-2',4'-(CH$_2$)$_2$-2', 4'-(CH$_2$)$_3$-2',4'-CH$_2$—O-2',4'-(CH$_2$)$_2$—O-2',4'-CH$_2$—O—N(R)-2' and 4'-CH$_2$—N(R)—O-2'- wherein each R is, independently, H, a protecting group or $C_1$-$C_{12}$ alkyl.

In certain embodiments, bicyclic nucleosides are further defined by isomeric configuration. For example, a nucleoside comprising a 4'-2' methylene-oxy bridge, may be in the α-L configuration or in the β-D configuration. Previously, α-L-methyleneoxy (4'-CH$_2$—O-2') BNA's have been incorporated into antisense oligonucleotides that showed antisense activity (Frieden et al., *Nucleic Acids Research,* 2003, 21, 6365-6372).

In certain embodiments, bicyclic nucleosides include, but are not limited to, (A) α-L-methyleneoxy (4'-CH$_2$—O-2') BNA, (B) β-D-methyleneoxy (4'-CH$_2$—O-2') BNA, (C) ethyleneoxy (4'-(CH$_2$)$_2$—O-2') BNA, (D) aminooxy (4'-CH$_2$—O—N(R)-2') BNA, (E) oxyamino (4'-CH$_2$—N(R)—O-2') BNA, and (F) methyl(methyleneoxy) (4'-CH(CH$_3$)—O-2') BNA, (G) methylene-thio (4'-CH$_2$—S-2') BNA, (H) methylene-amino (4'-CH$_2$—N(R)-2') BNA, (I) methyl carbocyclic (4'-CH$_2$—CH(CH$_3$)-2') BNA, (J) propylene carbocyclic (4'-(CH$_2$)$_3$-2') BNA and (K) vinyl BNA as depicted below:

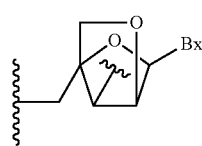
(A)

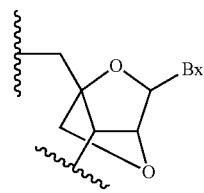
(B)

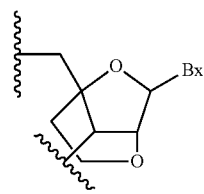
(C)

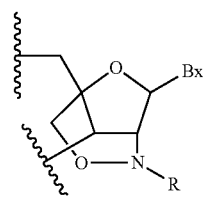
(D)

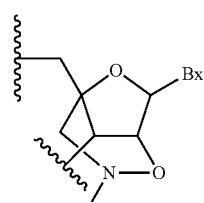
(E)

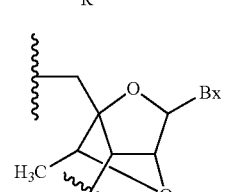
(F)

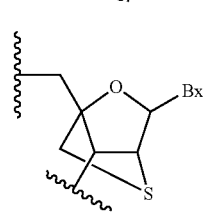
(G)

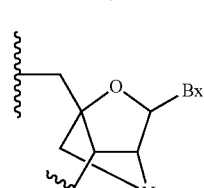
(H)

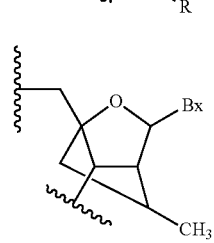
(I)

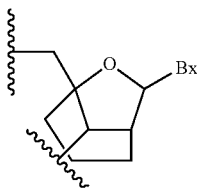
(J)

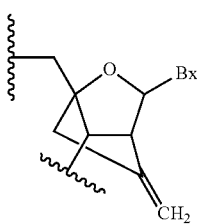
(K)

wherein Bx is the base moiety and R is independently H, a protecting group, $C_1$-$C_{12}$ alkyl or $C_1$-$C_{12}$ alkoxy.

In certain embodiments, bicyclic nucleosides are provided having Formula I:

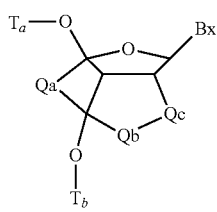
I wherein:

Bx is a heterocyclic base moiety;

-$Q_a$-$Q_b$-$Q_c$- is —$CH_2$—N($R_c$)—$CH_2$—, —C(=O)—N($R_e$)—$CH_2$—, —$CH_2$—O—N($R_c$)—, —$CH_2$—N($R_c$)—O— or —N($R_c$)—O—$CH_2$;

$R_c$ is $C_1$-$C_{12}$ alkyl or an amino protecting group; and $T_a$ and $T_b$ are each, independently H, a hydroxyl protecting group, a conjugate group, a reactive phosphorus group, a phosphorus moiety or a covalent attachment to a support medium.

In certain embodiments, bicyclic nucleosides are provided having Formula II:

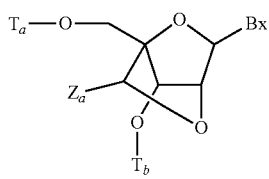
II wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_a$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol or substituted thio.

In one embodiment, each of the substituted groups is, independently, mono or poly substituted with substituent groups independently selected from halogen, oxo, hydroxyl, $OJ_c$, $NJ_cJ_d$, $SJ_c$, $N_3$, OC(=X)$J_e$, and $NJ_eC$(=X)$NJ_cJ_d$, wherein each $J_c$, $J_d$ and $J_e$ is, independently, H, $C_1$-$C_6$ alkyl, or substituted $C_1$-$C_6$ alkyl and X is O or $NJ_c$.

In certain embodiments, bicyclic nucleosides are provided having Formula III:

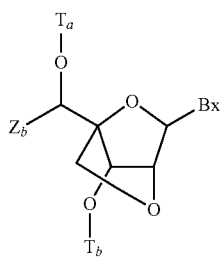
III wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_b$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl or substituted acyl (C(=O)—).

In certain embodiments, bicyclic nucleosides are provided having Formula IV:

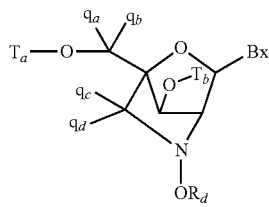
IV wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$R_d$ is $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl;

each $q_a$, $q_b$, $q_c$ and $q_d$ is, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl, $C_1$-$C_6$ alkoxyl, substituted $C_1$-$C_6$ alkoxyl, acyl, substituted acyl, $C_1$-$C_6$ aminoalkyl or substituted $C_1$-$C_6$ aminoalkyl;

In certain embodiments, bicyclic nucleosides are provided having Formula V:

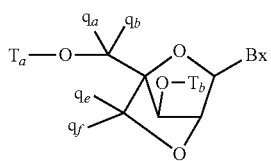

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$q_a$, $q_b$, $q_e$ and $q_f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$;

or $q_e$ and $q_f$ together are =C($q_g$)($q_h$);

$q_g$ and $q_h$ are each, independently, H, halogen, $C_1$-$C_{12}$ alkyl or substituted $C_1$-$C_{12}$ alkyl.

The synthesis and preparation of the methyleneoxy (4'-$CH_2$—O-2') BNA monomers adenine, cytosine, guanine, 5-methyl-cytosine, thymine and uracil, along with their oligomerization, and nucleic acid recognition properties have been described (Koshkin et al., *Tetrahedron*, 1998, 54, 3607-3630). BNAs and preparation thereof are also described in WO 98/39352 and WO 99/14226.

Analogs of methyleneoxy (4'-$CH_2$—O-2') BNA and 2'-thio-BNAs, have also been prepared (Kumar et al., *Bioorg. Med. Chem. Lett.*, 1998, 8, 2219-2222). Preparation of locked nucleoside analogs comprising oligodeoxyribonucleotide duplexes as substrates for nucleic acid polymerases has also been described (Wengel et al., WO 99/14226). Furthermore, synthesis of 2'-amino-BNA, a novel comformationally restricted high-affinity oligonucleotide analog has been described in the art (Singh et al., *J Org. Chem.*, 1998, 63, 10035-10039). In addition, 2'-amino- and 2'-methylamino-BNA's have been prepared and the thermal stability of their duplexes with complementary RNA and DNA strands has been previously reported.

In certain embodiments, bicyclic nucleosides are provided having Formula VI:

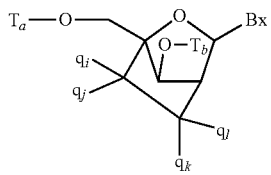

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

each $q_i$, $q_j$, $q_k$ and $q_l$ is, independently, H, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxyl, substituted $C_1$-$C_{12}$ alkoxyl, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$; and $q_i$ and $q_j$ or $q_l$ and $q_k$ together are =C($q_g$)($q_h$), wherein $q_g$ and $q_h$ are each, independently, H, halogen, $C_1$-$C_{12}$ alkyl or substituted $C_1$-$C_{12}$ alkyl.

One carbocyclic bicyclic nucleoside having a 4'-($CH_2$)$_3$-2' bridge and the alkenyl analog bridge 4'-CH=CH—$CH_2$-2' have been described (Freier et al., *Nucleic Acids Research*, 1997, 25(22), 4429-4443 and Albaek et al., *J. Org. Chem.*, 2006, 71, 7731-7740). The synthesis and preparation of carbocyclic bicyclic nucleosides along with their oligomerization and biochemical studies have also been described (Srivastava et al., *J. Am. Chem. Soc.*, 2007, 129(26), 8362-8379).

As used herein, "4'-2' bicyclic nucleoside" or "4' to 2' bicyclic nucleoside" refers to a bicyclic nucleoside comprising a furanose ring comprising a bridge connecting two carbon atoms of the furanose ring connects the 2' carbon atom and the 4' carbon atom of the sugar ring.

As used herein, "monocyclic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: O[($CH_2$)$_n$O]$_m$$CH_3$, O($CH_2$)$_n$$NH_2$, O($CH_2$)$_n$$CH_3$, O($CH_2$)$_n$F, O($CH_2$)$_n$$ONH_2$, $OCH_2$C(=O)N(H)$CH_3$, and O($CH_2$)$_n$ON[($CH_2$)$_n$$CH_3$]$_2$, where n and m are from 1 to about 10. Other 2'-substituent groups can also be selected from: $C_1$-$C_{12}$ alkyl, substituted alkyl, alkenyl, alkynyl, alkaryl, aralkyl, O-alkaryl or O-aralkyl, SH, $SCH_3$, OCN, Cl, Br, CN, F, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving pharmacokinetic properties, or a group for improving the pharmacodynamic properties of an antisense compound, and other substituents having similar properties. In certain embodiments, modified nucleosides comprise a 2'-MOE side chain (Baker et al., *J. Biol. Chem.*, 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (Martin, *Helv. Chim. Acta*, 1995, 78, 486-504; Altmann et al., *Chimia*, 1996, 50, 168-176; Altmann et al., *Biochem. Soc. Trans.*, 1996, 24, 630-637; and Altmann et al., *Nucleosides Nucleotides*, 1997, 16, 917-926).

As used herein, a "modified tetrahydropyran nucleoside" or "modified THP nucleoside" means a nucleoside having a six-membered tetrahydropyran "sugar" substituted in for the pentofuranosyl residue in normal nucleosides (a sugar surrogate). Modified THP nucleosides include, but are not limited to, what is referred to in the art as hexitol nucleic acid (HNA), anitol nucleic acid (ANA), manitol nucleic acid (MNA) (see Leumann, *Bioorg. Med. Chem.*, 2002, 10, 841-854) or fluoro HNA (F-HNA) having a tetrahydropyran ring system as illustrated below:

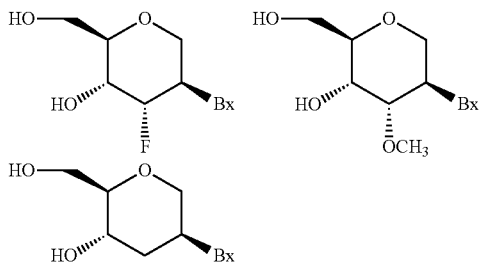

In certain embodiments, sugar surrogates are selected having Formula VII:

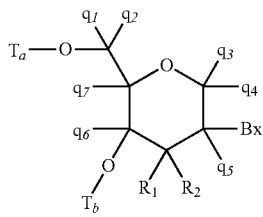

wherein independently for each of said at least one tetrahydropyran nucleoside analog of Formula VII:

Bx is a heterocyclic base moiety;

$T_a$ and $T_b$ are each, independently, an internucleoside linking group linking the tetrahydropyran nucleoside analog to the antisense compound or one of $T_a$ and $T_b$ is an internucleoside linking group linking the tetrahydropyran nucleoside analog to the antisense compound and the other of $T_a$ and $T_b$ is H, a hydroxyl protecting group, a linked conjugate group or a 5' or 3'-terminal group;

$q_1$, $q_2$, $q_3$, $q_4$, $q_5$, $q_6$ and $q_7$ are each independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl; and each of $R_1$ and $R_2$ is selected from hydrogen, hydroxyl, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$ and CN, wherein X is O, S or $NJ_1$ and each $J_1$, $J_2$ and $J_3$ is, independently, H or $C_1$-$C_6$ alkyl.

In certain embodiments, the modified THP nucleosides of Formula VII are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, THP nucleosides of Formula VII are provided wherein one of $R_1$ and $R_2$ is fluoro. In certain embodiments, $R_1$ is fluoro and $R_2$ is H; $R_1$ is methoxy and $R_2$ is H, and $R_1$ is methoxyethoxy and $R_2$ is H.

In certain embodiments, sugar surrogates comprise rings having more than 5 atoms and more than one heteroatom. For example nucleosides comprising morpholino sugar moieties and their use in oligomeric compounds has been reported (see for example: Braasch et al., *Biochemistry*, 2002, 41, 4503-4510; and U.S. Pat. Nos. 5,698,685; 5,166,315; 5,185,444; and 5,034,506). As used here, the term "morpholino" means a sugar surrogate having the following formula:

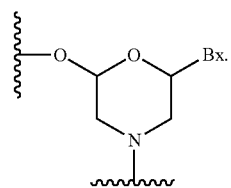

In certain embodiments, morpholinos may be modified, for example by adding or altering various substituent groups from the above morpholino structure. Such sugar surrogates are referred to herein as "modified morpholinos."

Combinations of modifications are also provided without limitation, such as 2'-F-5'-methyl substituted nucleosides (see PCT International Application WO 2008/101157 published on Aug. 21, 2008 for other disclosed 5',2'-bis substituted nucleosides) and replacement of the ribosyl ring oxygen atom with S and further substitution at the 2'-position (see published U.S. Patent Application US2005-0130923, published on Jun. 16, 2005) or alternatively 5'-substitution of a bicyclic nucleic acid (see PCT International Application WO 2007/134181, published on Nov. 22, 2007 wherein a 4'-$CH_2$—O-2' bicyclic nucleoside is further substituted at the 5' position with a 5'-methyl or a 5'-vinyl group). The synthesis and preparation of carbocyclic bicyclic nucleosides along with their oligomerization and biochemical studies have also been described (see, e.g., Srivastava et al., *J. Am. Chem. Soc.* 2007, 129(26), 8362-8379).

In certain embodiments, antisense compounds comprise one or more modified cyclohexenyl nucleosides, which is a nucleoside having a six-membered cyclohexenyl in place of the pentofuranosyl residue in naturally occurring nucleosides. Modified cyclohexenyl nucleosides include, but are not limited to those described in the art (see for example commonly owned, published PCT Application WO 2010/036696, published on Apr. 10, 2010, Robeyns et al., *J. Am. Chem. Soc.*, 2008, 130(6), 1979-1984; Horvath et al., *Tetrahedron Letters*, 2007, 48, 3621-3623; Nauwelaerts et al., *J. Am. Chem. Soc.*, 2007, 129(30), 9340-9348; Gu et al., *Nucleosides, Nucleotides & Nucleic Acids*, 2005, 24(5-7), 993-998; Nauwelaerts et al., *Nucleic Acids Research*, 2005, 33(8), 2452-2463; Robeyns et al., *Acta Crystallographica, Section F: Structural Biology and Crystallization Communications*, 2005, F61(6), 585-586; Gu et al., *Tetrahedron*, 2004, 60(9), 2111-2123; Gu et al., *Oligonucleotides*, 2003, 13(6), 479-489; Wang et al., *J. Org. Chem.*, 2003, 68, 4499-4505; Verbeure et al., *Nucleic Acids Research*, 2001, 29(24), 4941-4947; Wang et al., *J. Org. Chem.*, 2001, 66, 8478-82; Wang et al., *Nucleosides, Nucleotides & Nucleic Acids*, 2001, 20(4-7), 785-788; Wang et al., *J. Am. Chem.*, 2000, 122, 8595-8602; Published PCT application, WO 06/047842; and Published PCT Application WO 01/049687; the text of each is incorporated by reference herein, in their entirety). Certain modified cyclohexenyl nucleosides have Formula X.

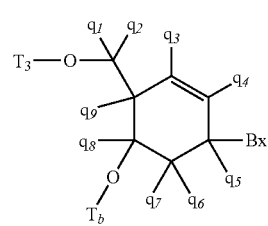

wherein independently for each of said at least one cyclohexenyl nucleoside analog of Formula X:

Bx is a heterocyclic base moiety;

$T_3$ and $T_4$ are each, independently, an internucleoside linking group linking the cyclohexenyl nucleoside analog to an antisense compound or one of $T_3$ and $T_4$ is an internucleoside linking group linking the tetrahydropyran nucleoside analog to an antisense compound and the other of $T_3$ and $T_4$ is H, a hydroxyl protecting group, a linked conjugate group, or a 5'- or 3'-terminal group; and $q_1$, $q_2$, $q_3$, $q_4$, $q_5$, $q_6$, $q_7$, $q_8$ and $q_9$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or other sugar substituent group.

As used herein, "2'-modified" or "2'-substituted" refers to a nucleoside comprising a sugar comprising a substituent at the 2' position other than H or OH. 2'-modified nucleosides, include, but are not limited to, bicyclic nucleosides wherein the bridge connecting two carbon atoms of the sugar ring connects the 2' carbon and another carbon of the sugar ring; and nucleosides with non-bridging 2 'substituents, such as allyl, amino, azido, thio, O-allyl, O—$C_1$-$C_{10}$ alkyl, —$OCF_3$, O—$(CH_2)_2$—O—$CH_3$, 2'-O$(CH_2)_2SCH_3$, O—$(CH_2)_2$—O—$N(R_m)(R_n)$, or O—$CH_2$—$C(=O)$—$N(R_m)(R_n)$, where each $R_m$ and $R_n$ is, independently, H or substituted or unsubstituted $C_1$-$C_{10}$ alkyl. 2'-modified nucleosides may further comprise other modifications, for example at other positions of the sugar and/or at the nucleobase.

As used herein, "2'-F" refers to a nucleoside comprising a sugar comprising a fluoro group at the 2' position of the sugar ring.

As used herein, "2'-OMe" or "2'-$OCH_3$" or "2'-O-methyl" each refers to a nucleoside comprising a sugar comprising an —$OCH_3$ group at the 2' position of the sugar ring.

As used herein, "MOE" or "2'-MOE" or "2'-$OCH_2CH_2OCH_3$" or "2'-O-methoxyethyl" each refers to a nucleoside comprising a sugar comprising a —$OCH_2CH_2OCH_3$ group at the 2' position of the sugar ring.

As used herein, "oligonucleotide" refers to a compound comprising a plurality of linked nucleosides. In certain embodiments, one or more of the plurality of nucleosides is modified. In certain embodiments, an oligonucleotide comprises one or more ribonucleosides (RNA) and/or deoxyribonucleosides (DNA).

Many other bicyclo and tricyclo sugar surrogate ring systems are also known in the art that can be used to modify nucleosides for incorporation into antisense compounds (see for example review article: Leumann, *Bioorg. Med. Chem.*, 2002, 10, 841-854). Such ring systems can undergo various additional substitutions to enhance activity.

Methods for the preparations of modified sugars are well known to those skilled in the art. Some representative U.S. patents that teach the preparation of such modified sugars include without limitation, U.S. Pat Nos.: 4,981,957; 5,118, 800; 5,319,080; 5,359,044; 5,393,878; 5,446,137; 5,466, 786; 5,514,785; 5,519,134; 5,567,811; 5,576,427; 5,591, 722; 5,597,909; 5,610,300; 5,627,053; 5,639,873; 5,646, 265; 5,670,633; 5,700,920; 5,792,847 and 6,600,032 and International Application PCT/US2005/019219, filed Jun. 2, 2005 and published as WO 2005/121371 on Dec. 22, 2005, and each of which is herein incorporated by reference in its entirety.

In nucleotides having modified sugar moieties, the nucleobase moieties (natural, modified or a combination thereof) are maintained for hybridization with an appropriate nucleic acid target.

In certain embodiments, antisense compounds comprise one or more nucleosides having modified sugar moieties. In certain embodiments, the modified sugar moiety is 2'-MOE. In certain embodiments, the 2'-MOE modified nucleosides are arranged in a gapmer motif. In certain embodiments, the modified sugar moiety is a bicyclic nucleoside having a (4'-$CH(CH_3)$—O-2') bridging group. In certain embodiments, the (4'-$CH(CH_3)$—O-2') modified nucleosides are arranged throughout the wings of a gapmer motif.

Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds. Modified nucleobases include synthetic and natural nucleobases such as, for example, 5-methylcytosine (5-me-C). Certain nucleobase substitutions, including 5-methylcytosine substitutions, are particularly useful for increasing the binding affinity of an antisense compound for a target nucleic acid. For example, 5-methylcytosine substitutions have been shown to increase nucleic acid duplex stability by 0.6-1.2° C. (Sanghvi, Y. S., Crooke, S. T. and Lebleu, B., eds., Antisense Research and Applications, CRC Press, Boca Raton, 1993, pp. 276-278).

Additional modified nucleobases include 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH3) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine.

Heterocyclic base moieties can also include those in which the purine or pyrimidine base is replaced with other heterocycles, for example 7-deaza-adenine, 7-deazaguanosine, 2-aminopyridine and 2-pyridone. Nucleobases that are particularly useful for increasing the binding affinity of antisense compounds include 5-substituted pyrimidines, 6-azapyrimidines and N-2, N-6 and 0-6 substituted purines, including 2 aminopropyladenine, 5-propynyluracil and 5-propynylcytosine.

In certain embodiments, antisense compounds targeted to a GHR nucleic acid comprise one or more modified nucleobases. In certain embodiments, shortened or gap-widened antisense oligonucleotides targeted to a GHR nucleic acid comprise one or more modified nucleobases. In certain embodiments, the modified nucleobase is 5-methylcytosine. In certain embodiments, each cytosine is a 5-methylcytosine.

Conjugated Antisense Compounds

In certain embodiments, the present disclosure provides conjugated antisense compounds. In certain embodiments, the present disclosure provides conjugated antisense compounds comprising an antisense oligonucleotide complementary to a nucleic acid transcript. In certain embodiments, the present disclosure provides methods comprising contacting a cell with a conjugated antisense compound comprising an antisense oligonucleotide complementary to a nucleic acid transcript. In certain embodiments, the present disclosure provides methods comprising contacting a cell with a conjugated antisense compound comprising an antisense oligonucleotide and reducing the amount or activity of a nucleic acid transcript in a cell.

The asialoglycoprotein receptor (ASGP-R) has been described previously. See e.g., Park et al., PNAS vol. 102, No. 47, pp 17125-17129 (2005). Such receptors are expressed on liver cells, particularly hepatocytes. Further, it has been shown that compounds comprising clusters of three N-acetylgalactosamine (GalNAc) ligands are capable of binding to the ASGP-R, resulting in uptake of the compound into the cell. See e.g., Khorev et al., Bioorganic and Medicinal Chemistry, 16, 9, pp 5216-5231 (May 2008). Accordingly, conjugates comprising such GalNAc clusters have been used to facilitate uptake of certain compounds into liver cells, specifically hepatocytes. For example it has been shown that certain GalNAc-containing conjugates increase activity of duplex siRNA compounds in liver cells in vivo. In such instances, the GalNAc-containing conjugate is typically attached to the sense strand of the siRNA duplex. Since the sense strand is discarded before the antisense strand ultimately hybridizes with the target nucleic acid, there is little concern that the conjugate will interfere with activity. Typically, the conjugate is attached to the 3' end of the sense strand of the siRNA. See e.g., U.S. Pat. No. 8,106,022. Certain conjugate groups described herein are more active and/or easier to synthesize than conjugate groups previously described.

In certain embodiments of the present invention, conjugates are attached to single-stranded antisense compounds, including, but not limited to RNase H based antisense compounds and antisense compounds that alter splicing of a pre-mRNA target nucleic acid. In such embodiments, the conjugate should remain attached to the antisense compound long enough to provide benefit (improved uptake into cells) but then should either be cleaved, or otherwise not interfere with the subsequent steps necessary for activity, such as hybridization to a target nucleic acid and interaction with RNase H or enzymes associated with splicing or splice modulation. This balance of properties is more important in the setting of single-stranded antisense compounds than in siRNA compounds, where the conjugate may simply be attached to the sense strand. Disclosed herein are conjugated single-stranded antisense compounds having improved potency in liver cells in vivo compared with the same antisense compound lacking the conjugate. Given the required balance of properties for these compounds such improved potency is surprising.

In certain embodiments, conjugate groups herein comprise a cleavable moiety. As noted, without wishing to be bound by mechanism, it is logical that the conjugate should remain on the compound long enough to provide enhancement in uptake, but after that, it is desirable for some portion or, ideally, all of the conjugate to be cleaved, releasing the parent compound (e.g., antisense compound) in its most active form. In certain embodiments, the cleavable moiety is a cleavable nucleoside. Such embodiments take advantage of endogenous nucleases in the cell by attaching the rest of the conjugate (the cluster) to the antisense oligonucleotide through a nucleoside via one or more cleavable bonds, such as those of a phosphodiester linkage. In certain embodiments, the cluster is bound to the cleavable nucleoside through a phosphodiester linkage. In certain embodiments, the cleavable nucleoside is attached to the antisense oligonucleotide (antisense compound) by a phosphodiester linkage. In certain embodiments, the conjugate group may comprise two or three cleavable nucleosides. In such embodiments, such cleavable nucleosides are linked to one another, to the antisense compound and/or to the cluster via cleavable bonds (such as those of a phosphodiester linkage). Certain conjugates herein do not comprise a cleavable nucleoside and instead comprise a cleavable bond. It is shown that that sufficient cleavage of the conjugate from the oligonucleotide is provided by at least one bond that is vulnerable to cleavage in the cell (a cleavable bond).

In certain embodiments, conjugated antisense compounds are prodrugs. Such prodrugs are administered to an animal and are ultimately metabolized to a more active form. For example, conjugated antisense compounds are cleaved to remove all or part of the conjugate resulting in the active (or more active) form of the antisense compound lacking all or some of the conjugate.

In certain embodiments, conjugates are attached at the 5' end of an oligonucleotide. Certain such 5'-conjugates are cleaved more efficiently than counterparts having a similar conjugate group attached at the 3' end. In certain embodiments, improved activity may correlate with improved cleavage. In certain embodiments, oligonucleotides comprising a conjugate at the 5' end have greater efficacy than oligonucleotides comprising a conjugate at the 3' end (see, for example, Examples 56, 81, 83, and 84). Further, 5'-attachment allows simpler oligonucleotide synthesis. Typically, oligonucleotides are synthesized on a solid support in the 3' to 5' direction. To make a 3'-conjugated oligonucleotide, typically one attaches a pre-conjugated 3' nucleoside to the solid support and then builds the oligonucleotide as usual. However, attaching that conjugated nucleoside to the solid support adds complication to the synthesis. Further, using that approach, the conjugate is then present throughout the synthesis of the oligonucleotide and can become degraded during subsequent steps or may limit the sorts of reactions and reagents that can be used. Using the structures and techniques described herein for 5'-conjugated oligonucleotides, one can synthesize the oligonucleotide using standard automated techniques and introduce the conjugate with the final (5'-most) nucleoside or after the oligonucleotide has been cleaved from the solid support.

In view of the art and the present disclosure, one of ordinary skill can easily make any of the conjugates and conjugated oligonucleotides herein. Moreover, synthesis of certain such conjugates and conjugated oligonucleotides disclosed herein is easier and/or requires few steps, and is therefore less expensive than that of conjugates previously disclosed, providing advantages in manufacturing. For example, the synthesis of certain conjugate groups consists of fewer synthetic steps, resulting in increased yield, relative to conjugate groups previously described. Conjugate groups such as GalNAc3-10 in Example 46 and GalNAc3-7 in Example 48 are much simpler than previously described conjugates such as those described in U.S. Pat. No. 8,106,022 or U.S. Pat. No. 7,262,177 that require assembly of more chemical intermediates. Accordingly, these and other conjugates described herein have advantages over previously described compounds for use with any oligonucleotide, including single-stranded oligonucleotides and either strand of double-stranded oligonucleotides (e.g., siRNA).

Similarly, disclosed herein are conjugate groups having only one or two GalNAc ligands. As shown, such conjugates groups improve activity of antisense compounds. Such compounds are much easier to prepare than conjugates comprising three GalNAc ligands. Conjugate groups comprising one or two GalNAc ligands may be attached to any antisense compounds, including single-stranded oligonucleotides and either strand of double-stranded oligonucleotides (e.g., siRNA).

In certain embodiments, the conjugates herein do not substantially alter certain measures of tolerability. For example, it is shown herein that conjugated antisense compounds are not more immunogenic than unconjugated parent compounds. Since potency is improved, embodiments in which tolerability remains the same (or indeed even if tolerability worsens only slightly compared to the gains in potency) have improved properties for therapy.

In certain embodiments, conjugation allows one to alter antisense compounds in ways that have less attractive consequences in the absence of conjugation. For example, in certain embodiments, replacing one or more phosphorothioate linkages of a fully phosphorothioate antisense compound with phosphodiester linkages results in improvement in some measures of tolerability. For example, in certain instances, such antisense compounds having one or more phosphodiester are less immunogenic than the same compound in which each linkage is a phosphorothioate. However, in certain instances, as shown in Example 26, that same replacement of one or more phosphorothioate linkages with phosphodiester linkages also results in reduced cellular uptake and/or loss in potency. In certain embodiments, conjugated antisense compounds described herein tolerate such change in linkages with little or no loss in uptake and potency when compared to the conjugated full-phosphorothioate counterpart. In fact, in certain embodiments, for example, in Examples 44, 57, 59, and 86, oligonucleotides comprising a conjugate and at least one phosphodiester internucleoside linkage actually exhibit increased potency in vivo even relative to a full phosphorothioate counterpart also comprising the same conjugate. Moreover, since conjugation results in substantial increases in uptake/potency a small loss in that substantial gain may be acceptable to achieve improved tolerability. Accordingly, in certain embodiments, conjugated antisense compounds comprise at least one phosphodiester linkage In certain embodiments, conjugation of antisense compounds herein results in increased delivery, uptake and activity in hepatocytes. Thus, more compound is delivered to liver tissue. However, in certain embodiments, that increased delivery alone does not explain the entire increase in activity. In certain such embodiments, more compound enters hepatocytes. In certain embodiments, even that increased hepatocyte uptake does not explain the entire increase in activity. In such embodiments, productive uptake of the conjugated compound is increased. For example, as shown in Example 102, certain embodiments of GalNAc-containing conjugates increase enrichment of antisense oligonucleotides in hepatocytes versus non-parenchymal cells. This enrichment is beneficial for oligonucleotides that target genes that are expressed in hepatocytes.

In certain embodiments, conjugated antisense compounds herein result in reduced kidney exposure. For example, as shown in Example 20, the concentrations of antisense oligonucleotides comprising certain embodiments of GalNAc-containing conjugates are lower in the kidney than that of antisense oligonucleotides lacking a GalNAc-containing conjugate. This has several beneficial therapeutic implications. For therapeutic indications where activity in the kidney is not sought, exposure to kidney risks kidney toxicity without corresponding benefit. Moreover, high concentration in kidney typically results in loss of compound to the urine resulting in faster clearance. Accordingly for non-kidney targets, kidney accumulation is undesired.

In certain embodiments, the present disclosure provides conjugated antisense compounds represented by the formula:

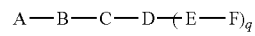

wherein
A is the antisense oligonucleotide;
B is the cleavable moiety
C is the conjugate linker
D is the branching group
each E is a tether;
each F is a ligand; and
q is an integer between 1 and 5.

In the above diagram and in similar diagrams herein, the branching group "D" branches as many times as is necessary to accommodate the number of (E-F) groups as indicated by "q". Thus, where q=1, the formula is:

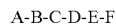

where q=2, the formula is:

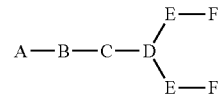

where q=3, the formula is:

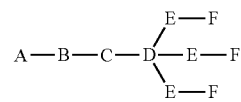

where q=4, the formula is:

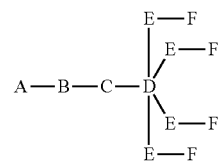

where q=5, the formula is:

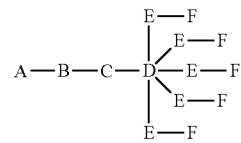

In certain embodiments, conjugated antisense compounds are provided having the structure:

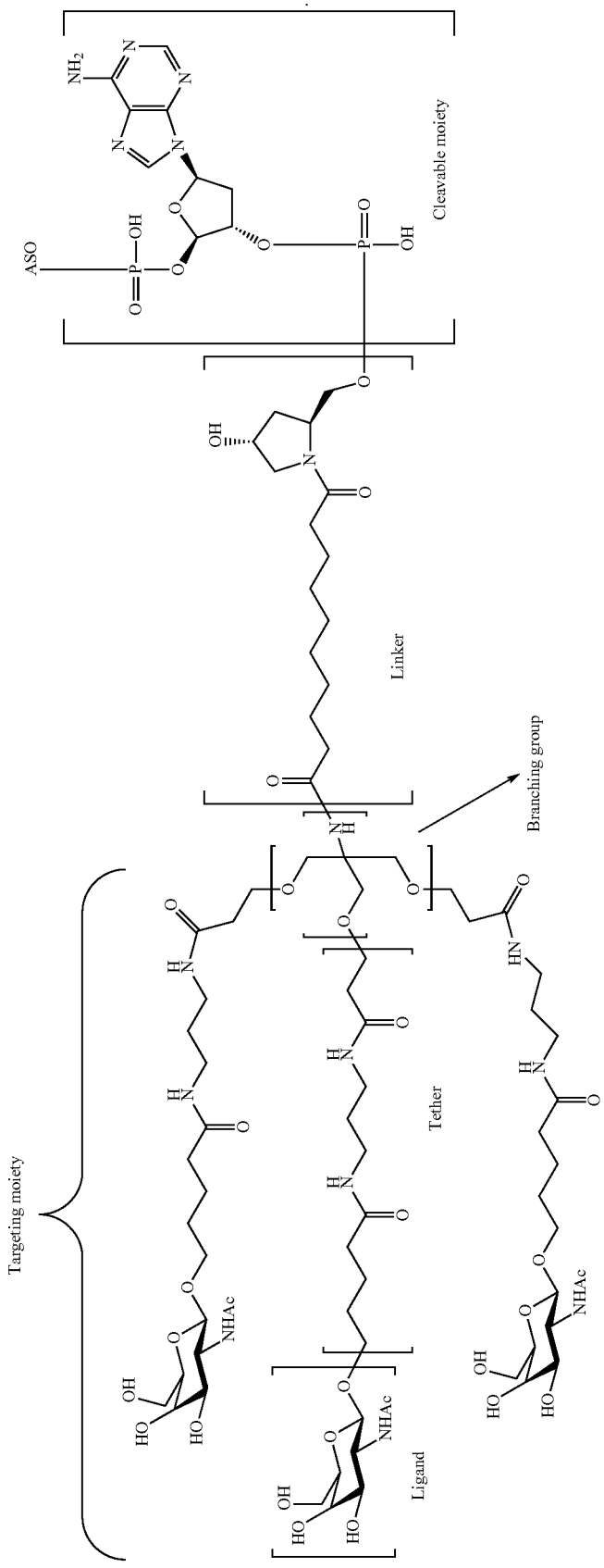

In certain embodiments, conjugated antisense compounds are provided having the structure:
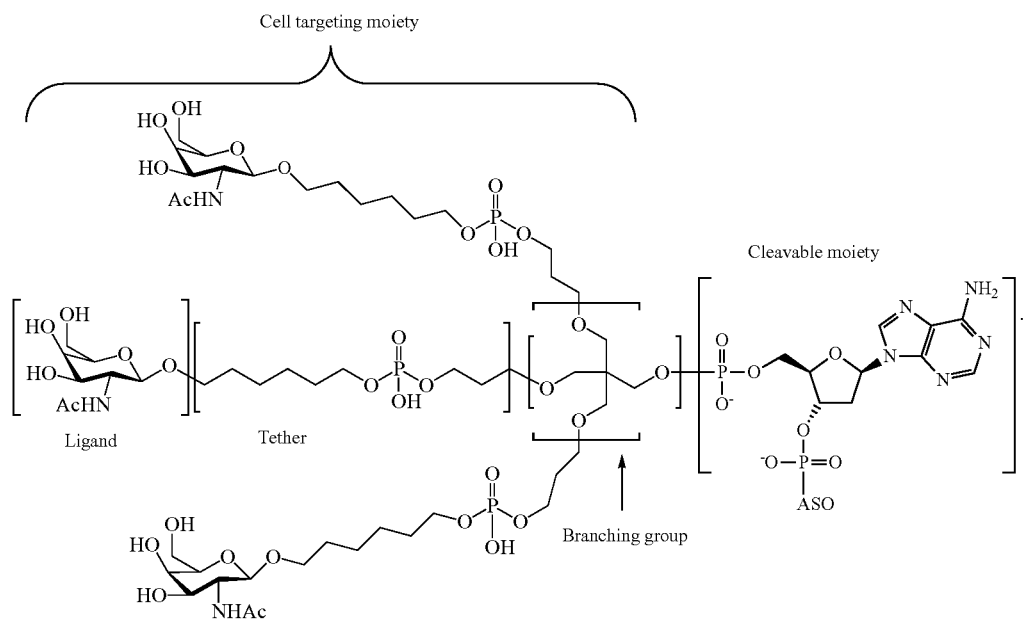
In certain embodiments, conjugated antisense compounds are provided having the structure:
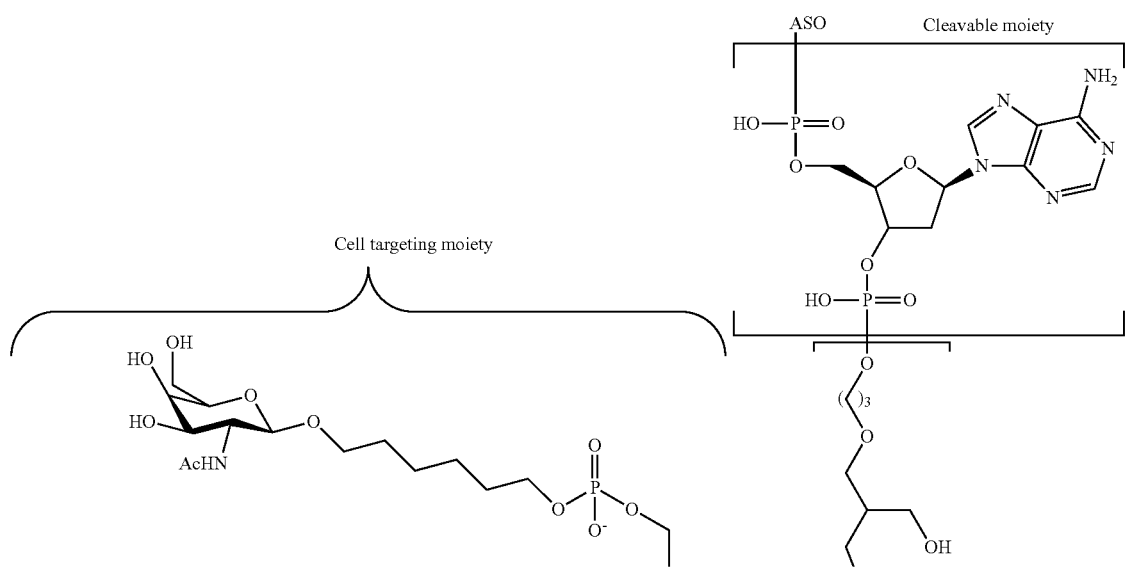

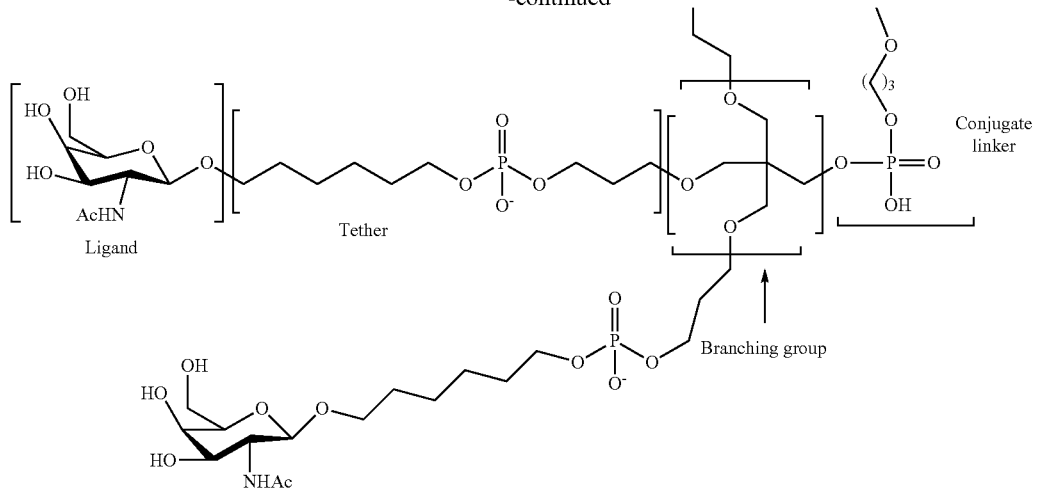

In certain embodiments, conjugated antisense compounds are provided having the structure:

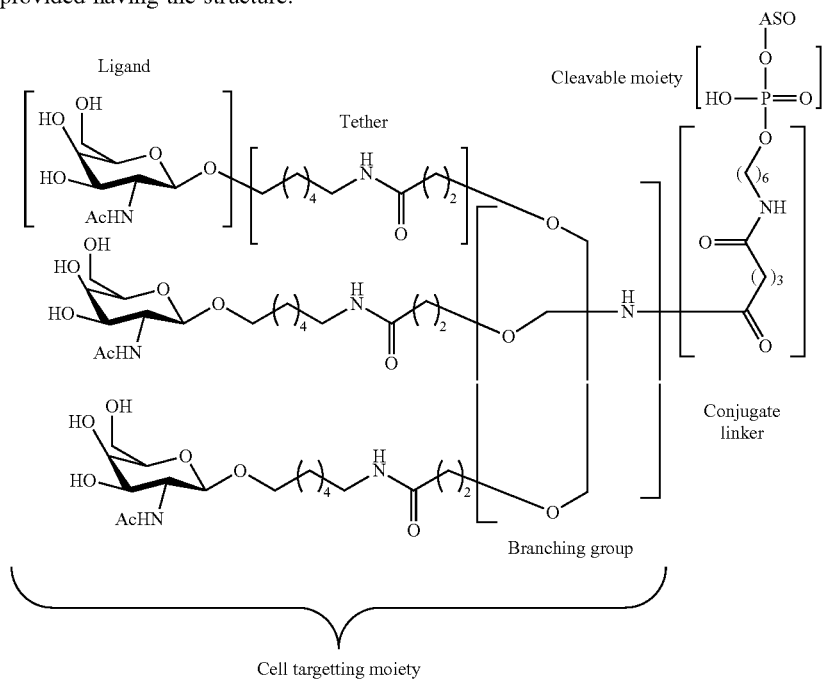

The present disclosure provides the following non-limiting numbered embodiments:

Embodiment 1. The conjugated antisense compound of any of embodiments 1179 to 1182, wherein the tether has a structure selected from among:

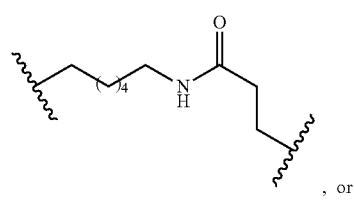

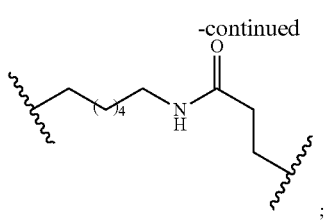

wherein each n is independently, 0, 1, 2, 3, 4, 5, 6, or 7.

Embodiment 2. The conjugated antisense compound of any of embodiments 1179 to 1182, wherein the tether has the structure:

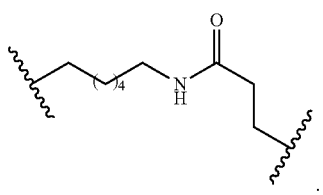

Embodiment 3. The conjugated antisense compound of any of embodiments 1179 to 1182 or 1688 to 1689, wherein the linker has a structure selected from among:

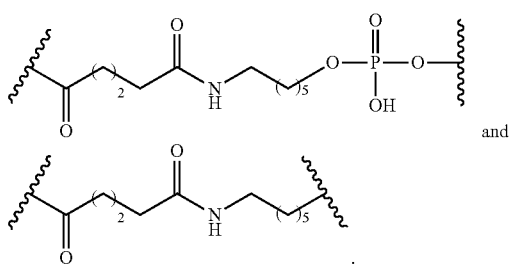

and

Embodiment 4. The conjugated antisense compound of any of embodiments 1179 to 1182 or 1688 to 1689, wherein the linker has a structure selected from among:

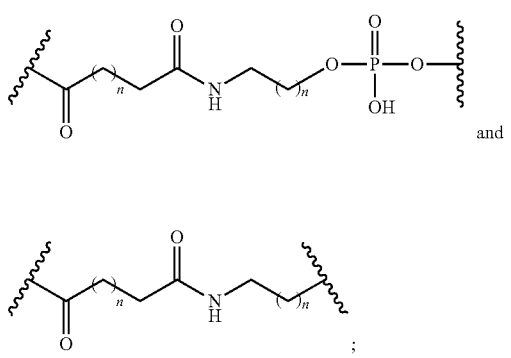

wherein each n is independently, 0, 1, 2, 3, 4, 5, 6, or 7.

Embodiment 5. The conjugated antisense compound of any of embodiments 1179 to 1182 or 1688 to 1689, wherein the linker has the structure:

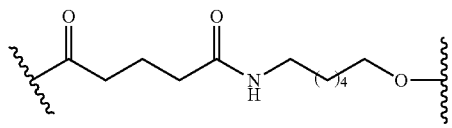

In embodiments having more than one of a particular variable (e.g., more than one "m" or "n"), unless otherwise indicated, each such particular variable is selected independently. Thus, for a structure having more than one n, each n is selected independently, so they may or may not be the same as one another.

i. Certain Cleavable Moieties

In certain embodiments, a cleavable moiety is a cleavable bond. In certain embodiments, a cleavable moiety comprises a cleavable bond. In certain embodiments, the conjugate group comprises a cleavable moiety. In certain such embodiments, the cleavable moiety attaches to the antisense oligonucleotide. In certain such embodiments, the cleavable moiety attaches directly to the cell-targeting moiety. In certain such embodiments, the cleavable moiety attaches to the conjugate linker. In certain embodiments, the cleavable moiety comprises a phosphate or phosphodiester. In certain embodiments, the cleavable moiety is a cleavable nucleoside or nucleoside analog. In certain embodiments, the nucleoside or nucleoside analog comprises an optionally protected heterocyclic base selected from a purine, substituted purine, pyrimidine or substituted pyrimidine. In certain embodiments, the cleavable moiety is a nucleoside comprising an optionally protected heterocyclic base selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. In certain embodiments, the cleavable moiety is 2'-deoxy nucleoside that is attached to the 3' position of the antisense oligonucleotide by a phosphodiester linkage and is attached to the linker by a phosphodiester or phosphorothioate linkage. In certain embodiments, the cleavable moiety is 2'-deoxy adenosine that is attached to the 3' position of the antisense oligonucleotide by a phosphodiester linkage and is attached to the linker by a phosphodiester or phosphorothioate linkage. In certain embodiments, the cleavable moiety is 2'-deoxy adenosine that is attached to the 3' position of the antisense oligonucleotide by a phosphodiester linkage and is attached to the linker by a phosphodiester linkage.

In certain embodiments, the cleavable moiety is attached to the 3' position of the antisense oligonucleotide. In certain embodiments, the cleavable moiety is attached to the 5' position of the antisense oligonucleotide. In certain embodiments, the cleavable moiety is attached to a 2' position of the antisense oligonucleotide. In certain embodiments, the cleavable moiety is attached to the antisense oligonucleotide by a phosphodiester linkage. In certain embodiments, the cleavable moiety is attached to the linker by either a phosphodiester or a phosphorothioate linkage. In certain embodiments, the cleavable moiety is attached to the linker by a phosphodiester linkage. In certain embodiments, the conjugate group does not include a cleavable moiety.

In certain embodiments, the cleavable moiety is cleaved after the complex has been administered to an animal only after being internalized by a targeted cell. Inside the cell the cleavable moiety is cleaved thereby releasing the active antisense oligonucleotide. While not wanting to be bound by theory it is believed that the cleavable moiety is cleaved by one or more nucleases within the cell. In certain embodiments, the one or more nucleases cleave the phosphodiester linkage between the cleavable moiety and the linker. In certain embodiments, the cleavable moiety has a structure selected from among the following:

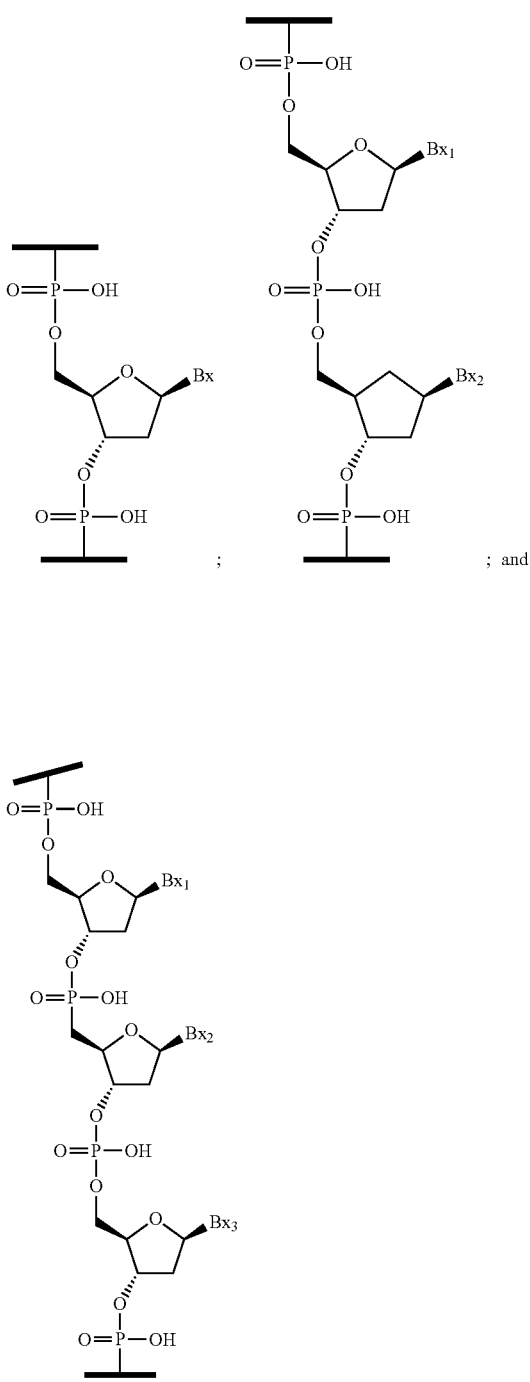

wherein each of Bx, Bx$_1$, Bx$_2$, and Bx$_3$ is independently a heterocyclic base moiety. In certain embodiments, the cleavable moiety has a structure selected from among the following:

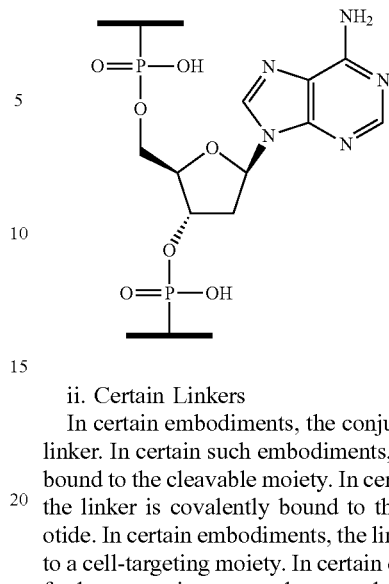

ii. Certain Linkers

In certain embodiments, the conjugate groups comprise a linker. In certain such embodiments, the linker is covalently bound to the cleavable moiety. In certain such embodiments, the linker is covalently bound to the antisense oligonucleotide. In certain embodiments, the linker is covalently bound to a cell-targeting moiety. In certain embodiments, the linker further comprises a covalent attachment to a solid support. In certain embodiments, the linker further comprises a covalent attachment to a protein binding moiety. In certain embodiments, the linker further comprises a covalent attachment to a solid support and further comprises a covalent attachment to a protein binding moiety. In certain embodiments, the linker includes multiple positions for attachment of tethered ligands. In certain embodiments, the linker includes multiple positions for attachment of tethered ligands and is not attached to a branching group. In certain embodiments, the linker further comprises one or more cleavable bond. In certain embodiments, the conjugate group does not include a linker.

In certain embodiments, the linker includes at least a linear group comprising groups selected from alkyl, amide, disulfide, polyethylene glycol, ether, thioether (—S—) and hydroxylamino (—O—N(H)—) groups. In certain embodiments, the linear group comprises groups selected from alkyl, amide and ether groups. In certain embodiments, the linear group comprises groups selected from alkyl and ether groups. In certain embodiments, the linear group comprises at least one phosphorus linking group. In certain embodiments, the linear group comprises at least one phosphodiester group. In certain embodiments, the linear group includes at least one neutral linking group. In certain embodiments, the linear group is covalently attached to the cell-targeting moiety and the cleavable moiety. In certain embodiments, the linear group is covalently attached to the cell-targeting moiety and the antisense oligonucleotide. In certain embodiments, the linear group is covalently attached to the cell-targeting moiety, the cleavable moiety and a solid support. In certain embodiments, the linear group is covalently attached to the cell-targeting moiety, the cleavable moiety, a solid support and a protein binding moiety. In certain embodiments, the linear group includes one or more cleavable bond.

In certain embodiments, the linker includes the linear group covalently attached to a scaffold group. In certain embodiments, the scaffold includes a branched aliphatic group comprising groups selected from alkyl, amide, disulfide, polyethylene glycol, ether, thioether and hydroxylamino groups. In certain embodiments, the scaffold includes a branched aliphatic group comprising groups selected from alkyl, amide and ether groups. In certain embodiments, the scaffold includes at least one mono or polycyclic ring system. In certain embodiments, the scaffold includes at least two mono or polycyclic ring systems. In certain embodiments, the linear group is covalently attached to the scaffold group and the scaffold group is covalently attached to the cleavable moiety and the linker. In certain embodiments, the linear group is covalently attached to the scaffold group and the scaffold group is covalently attached to the cleavable moiety, the linker and a solid support. In certain embodiments, the linear group is covalently attached to the scaffold group and the scaffold group is covalently attached to the cleavable moiety, the linker and a protein binding moiety. In certain embodiments, the linear group is covalently attached to the scaffold group and the scaffold group is covalently attached to the cleavable moiety, the linker, a protein binding moiety and a solid support. In certain embodiments, the scaffold group includes one or more cleavable bond.

In certain embodiments, the linker includes a protein binding moiety. In certain embodiments, the protein binding moiety is a lipid such as for example including but not limited to cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, e.g., sarsasapogenin, friedelin, epifriedelanol derivatized lithocholic acid), or a cationic lipid. In certain embodiments, the protein binding moiety is a C16 to C22 long chain saturated or unsaturated fatty acid, cholesterol, cholic acid, vitamin E, adamantane or 1-pentafluoropropyl.

In certain embodiments, a linker has a structure selected from among:

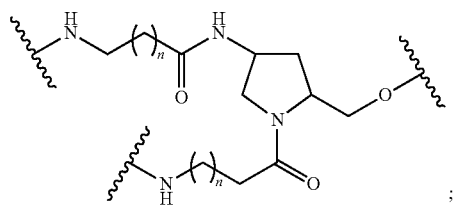

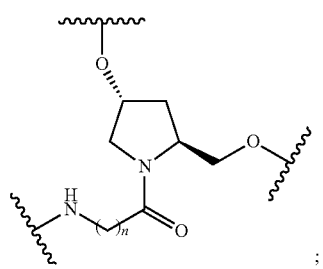

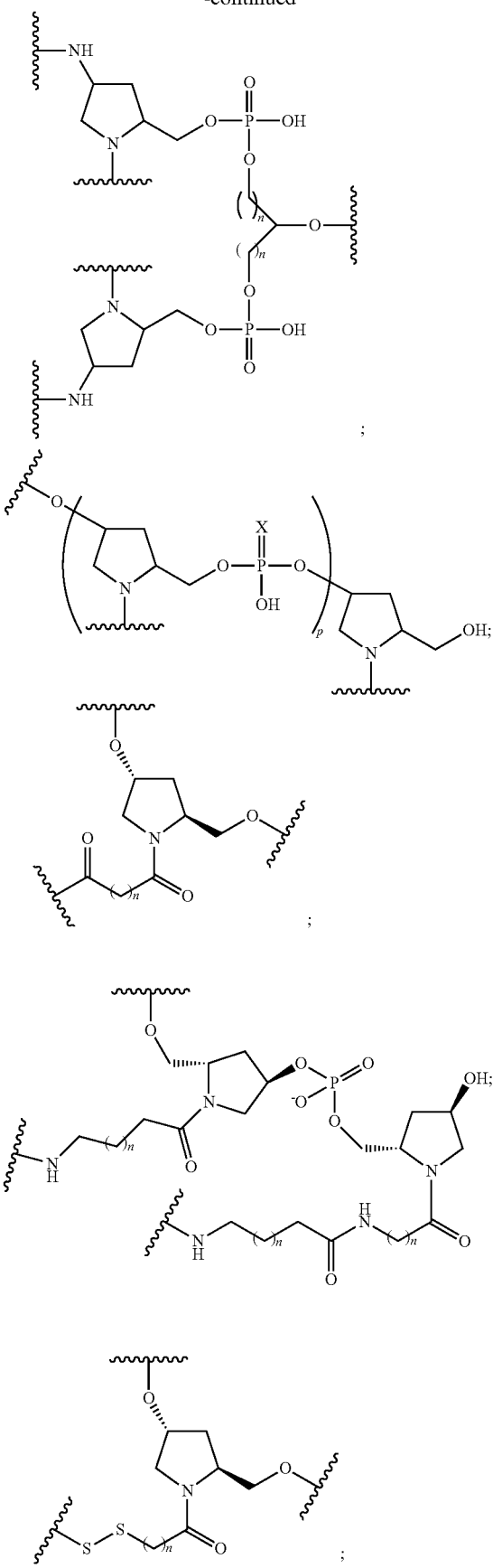

-continued
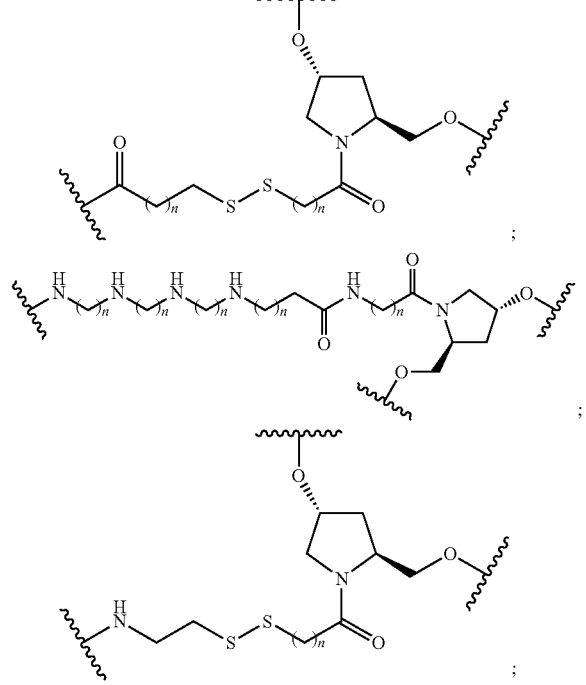
-continued
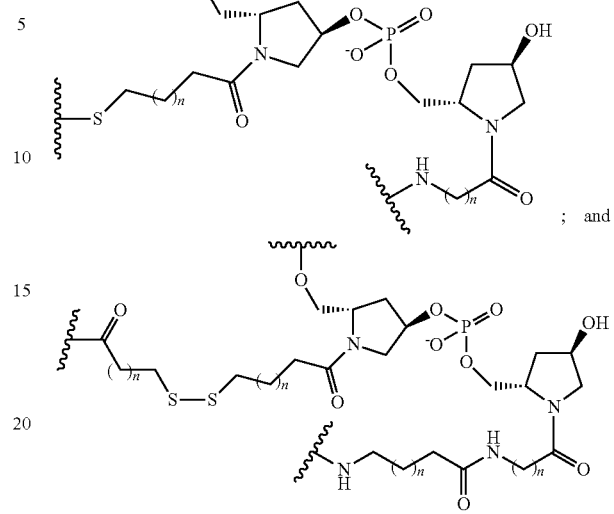
wherein each n is, independently, from 1 to 20; and p is from 1 to 6.
In certain embodiments, a linker has a structure selected from among:
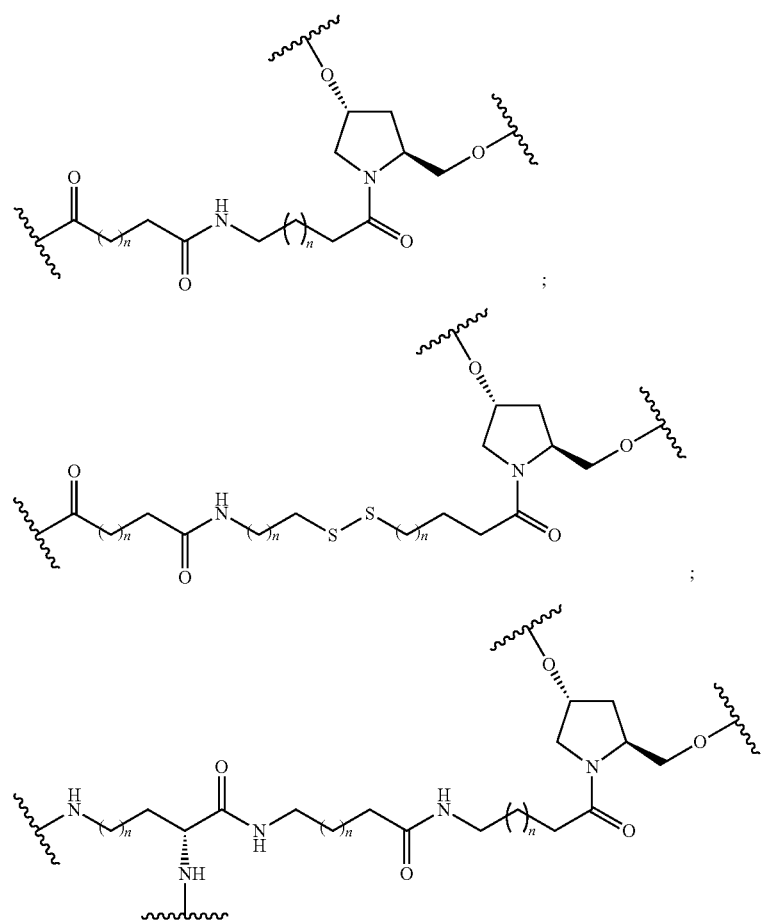

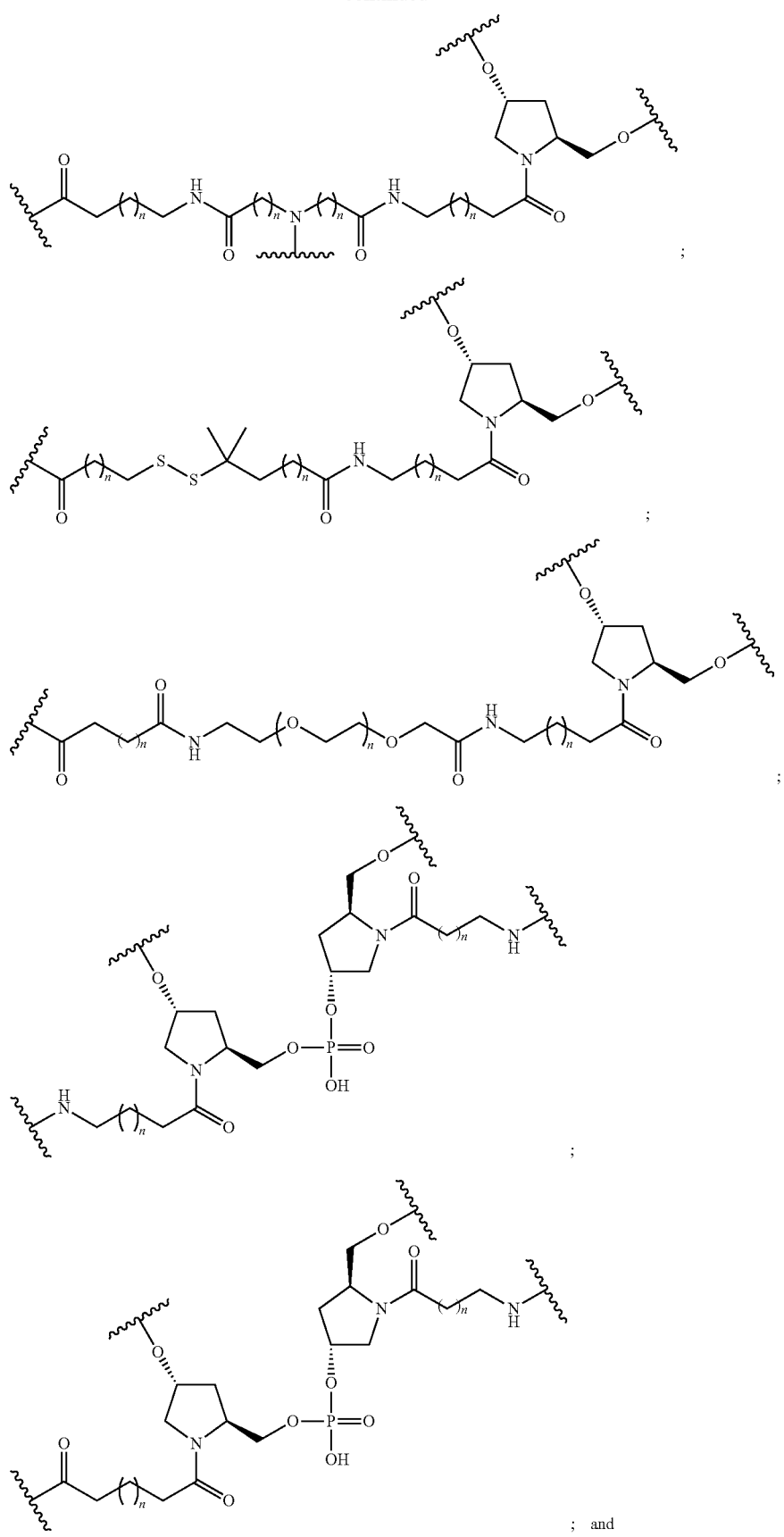

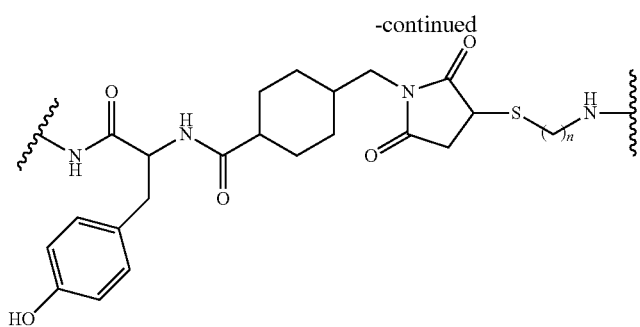
wherein each n is, independently, from 1 to 20.
In certain embodiments, a linker has a structure selected from among:
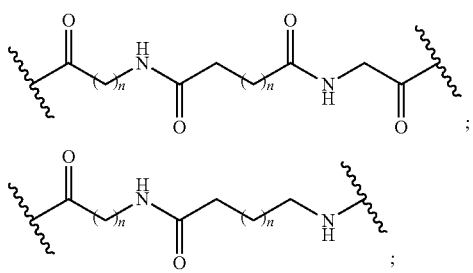
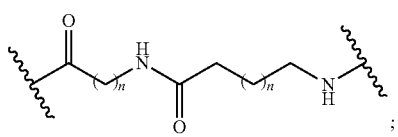
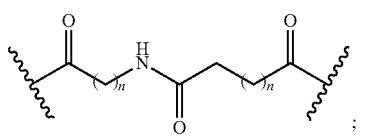
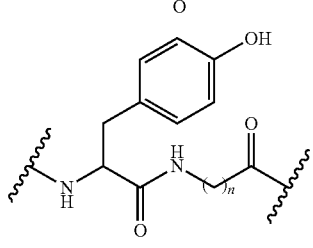
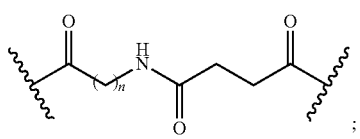
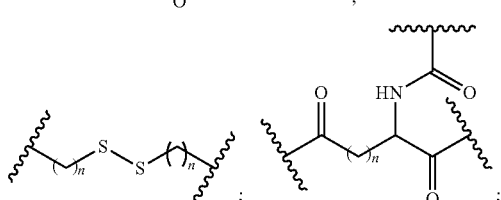
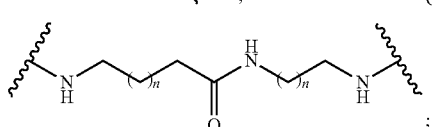
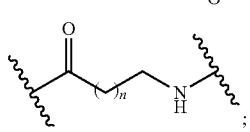
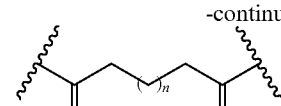
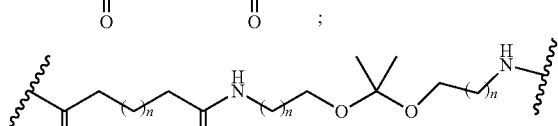
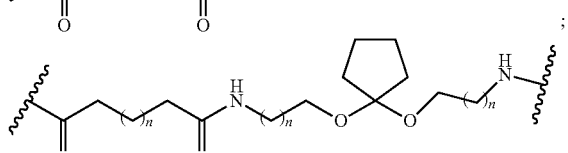
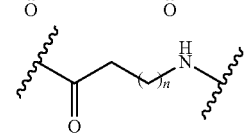
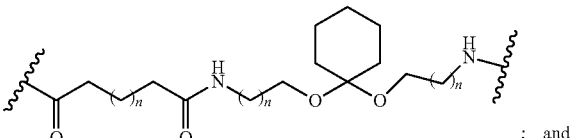
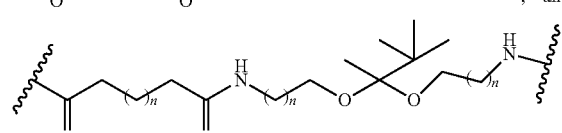
; and
wherein n is from 1 to 20.
In certain embodiments, a linker has a structure selected from among:
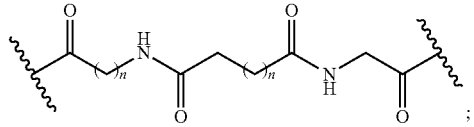
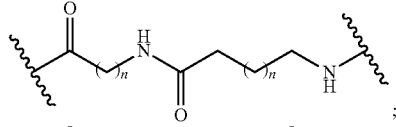
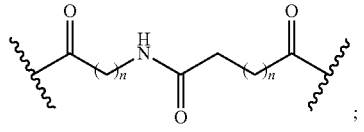

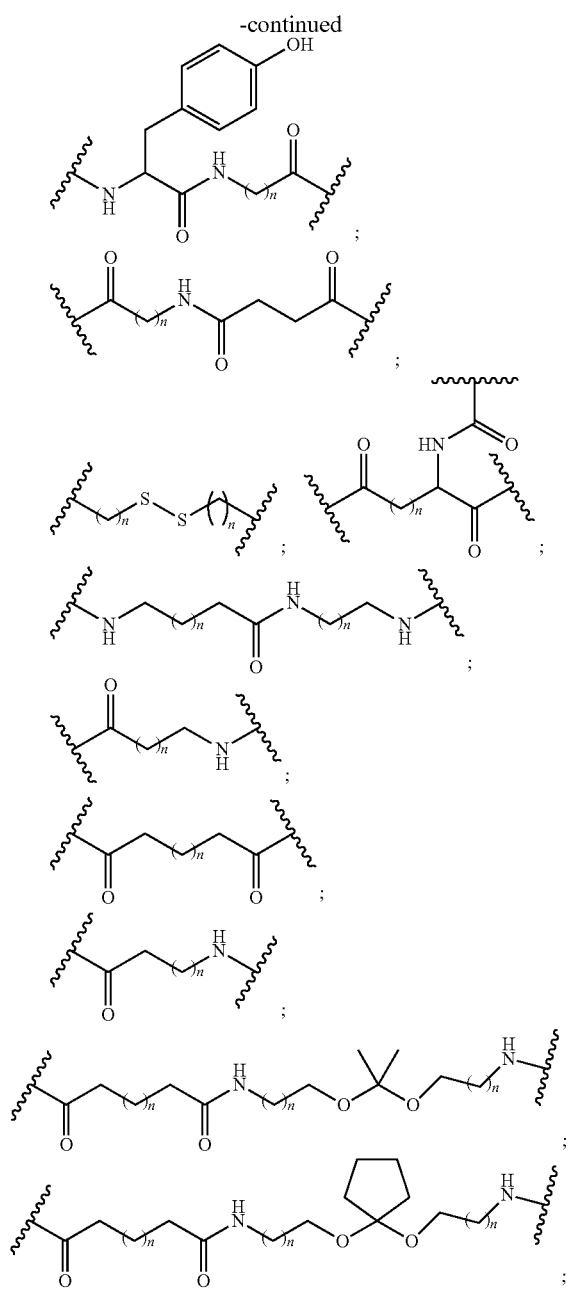
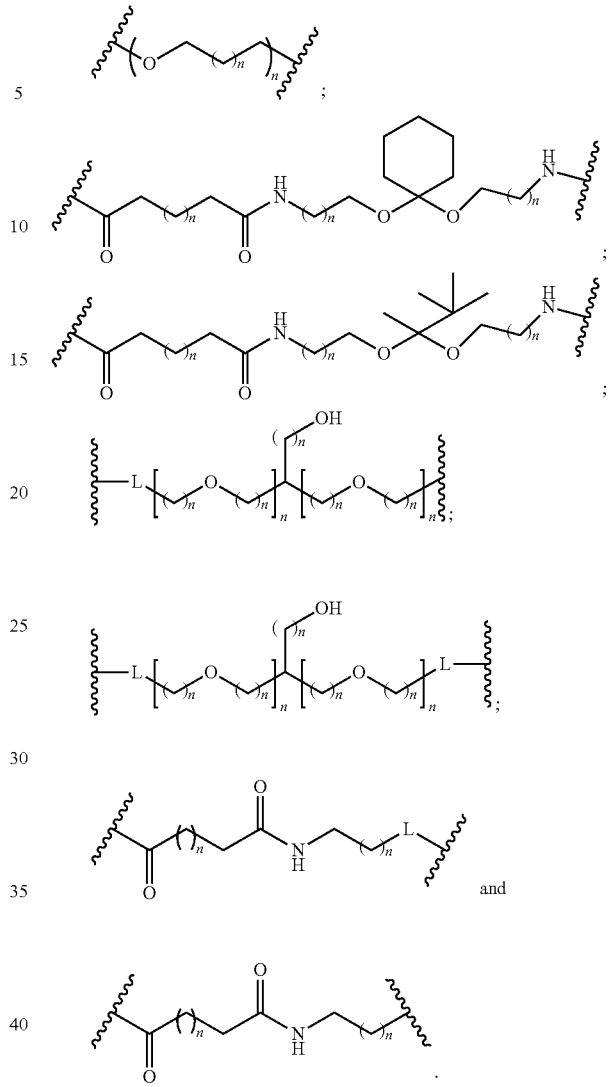
wherein each L is, independently, a phosphorus linking group or a neutral linking group; and
each n is, independently, from 1 to 20.
In certain embodiments, a linker has a structure selected from among:
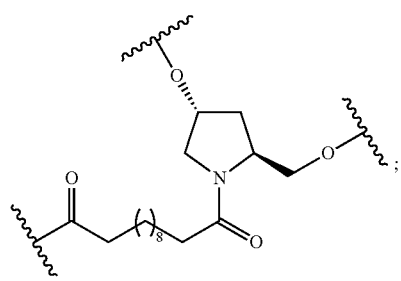

-continued
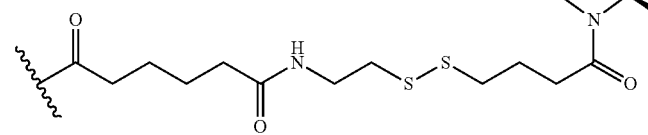
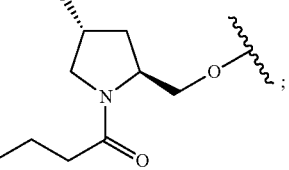
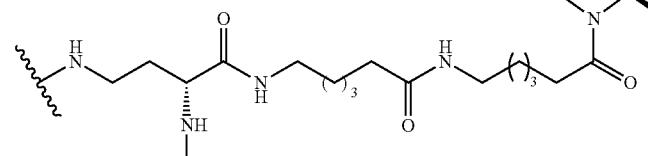
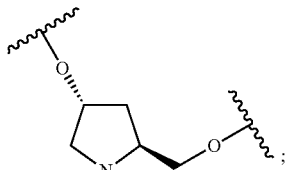
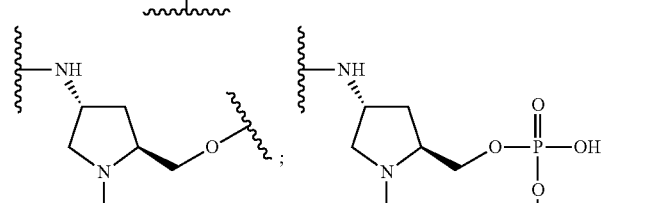
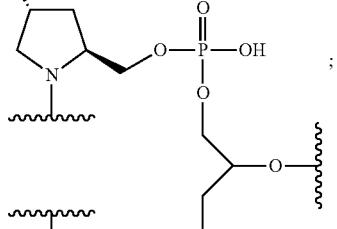
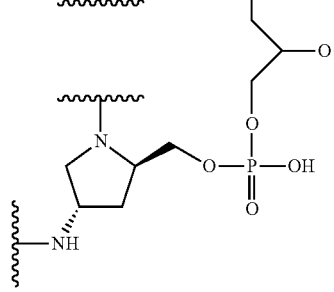
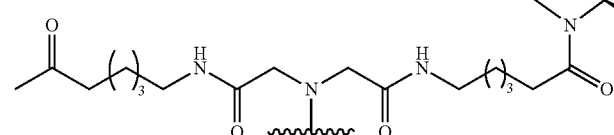
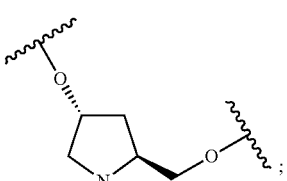
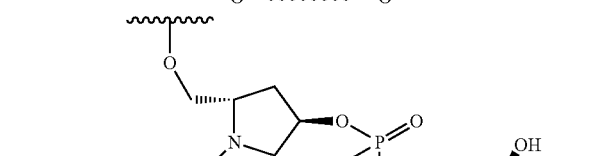
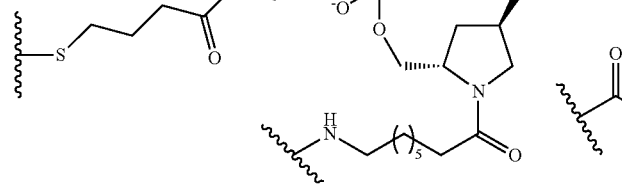
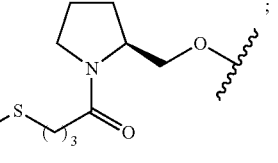

-continued
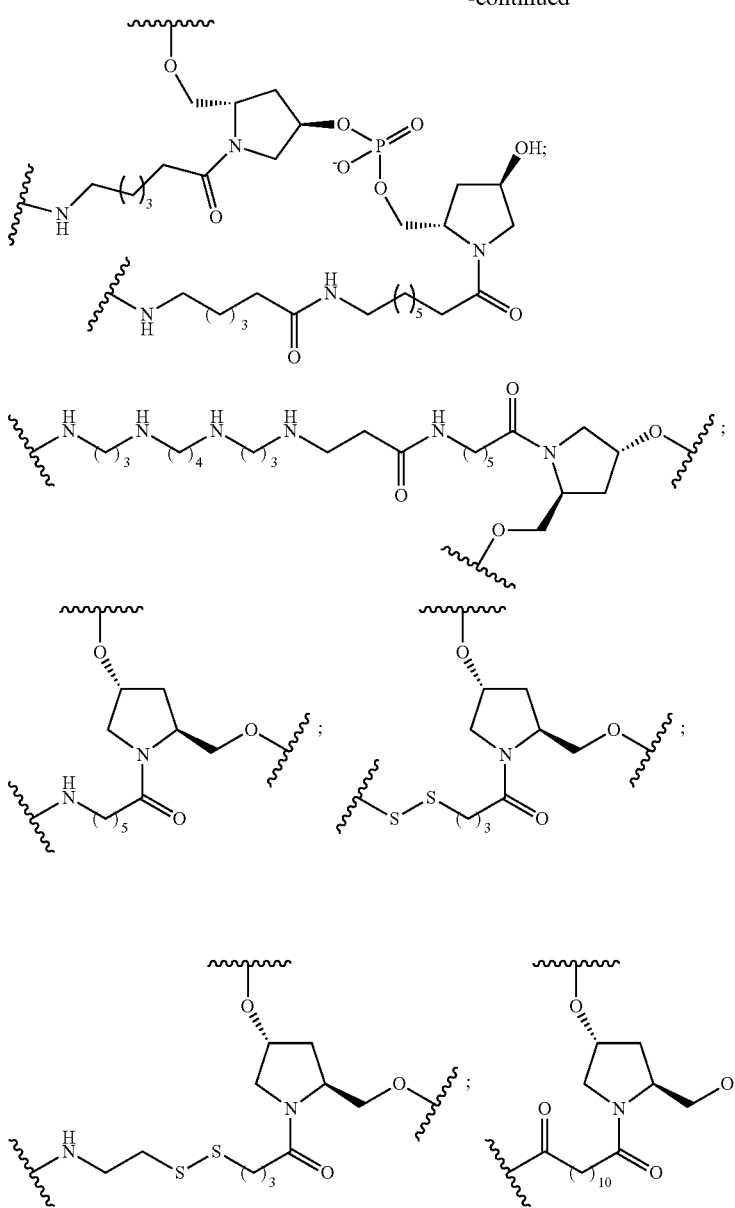
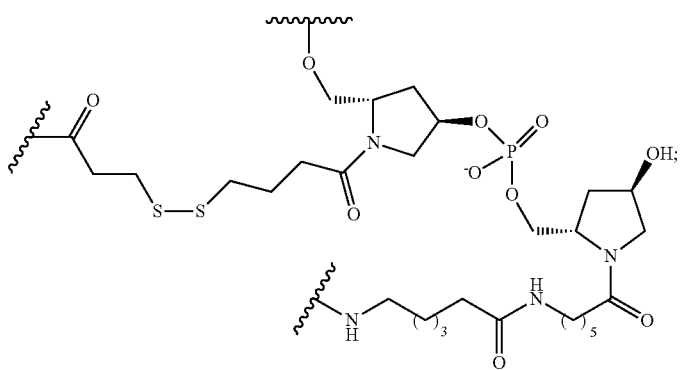

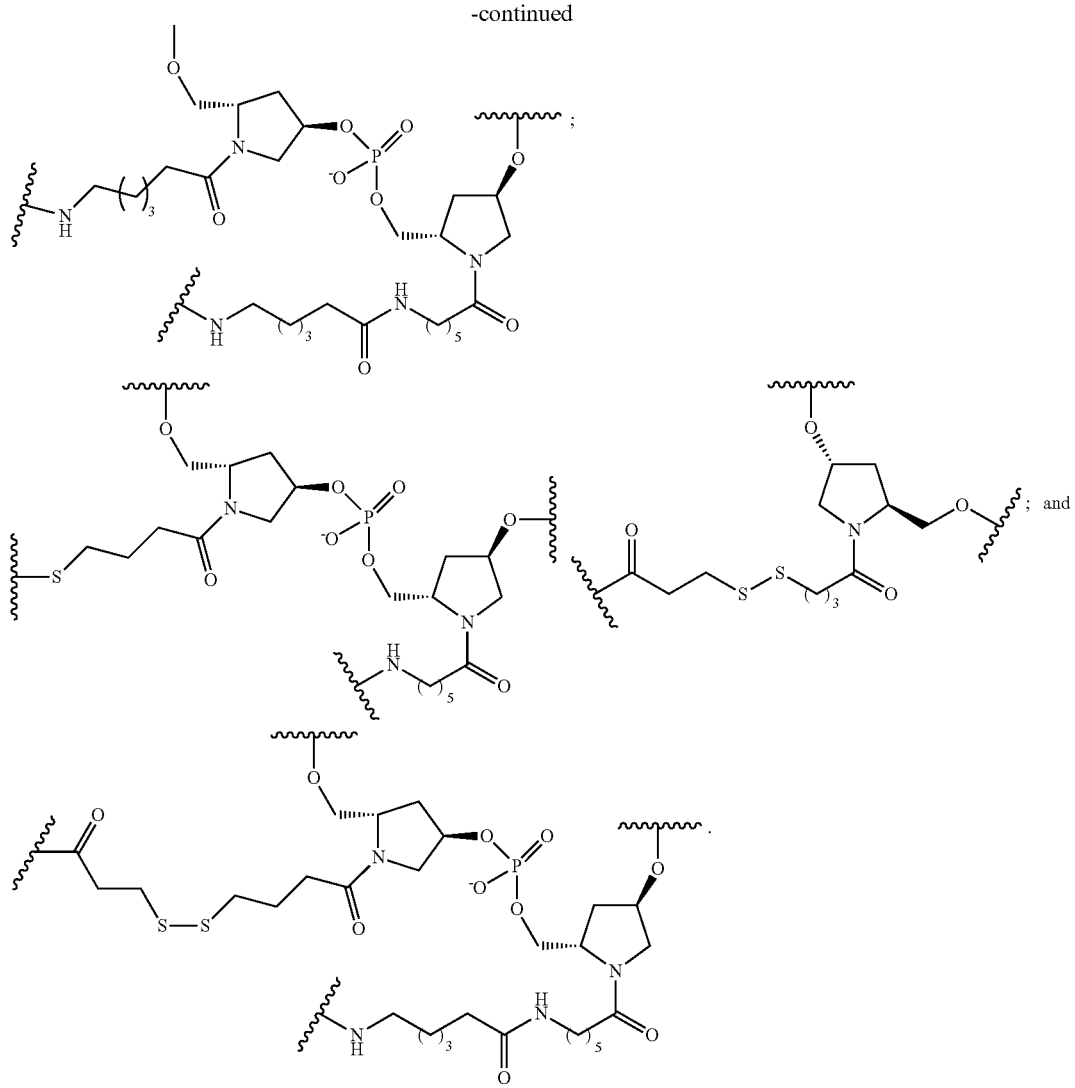
In certain embodiments, a linker has a structure selected from among:
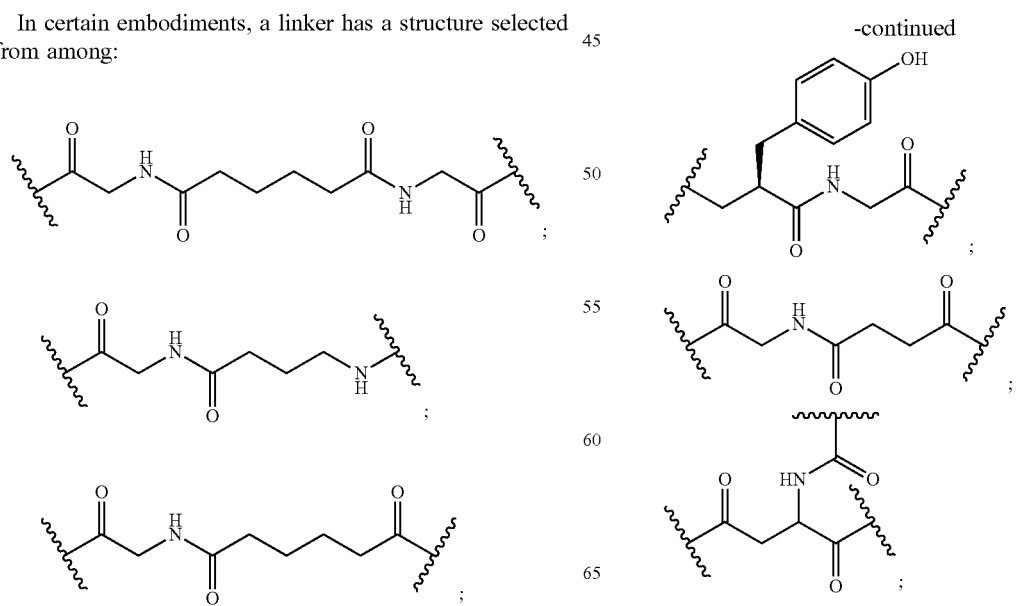

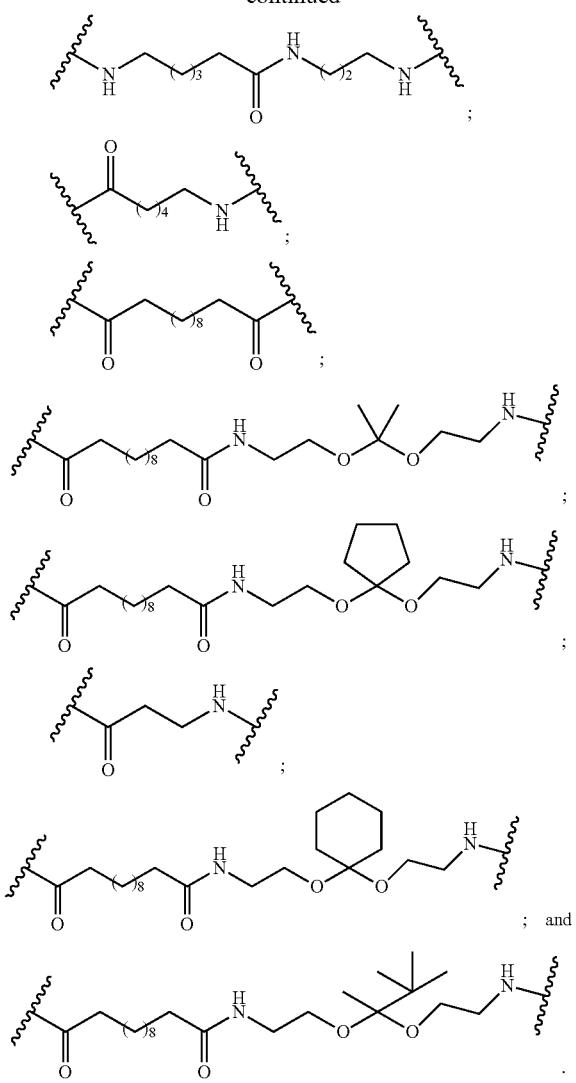
In certain embodiments, a linker has a structure selected from among:
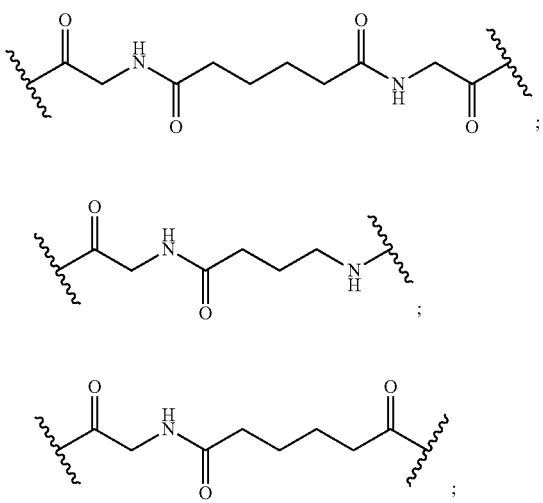
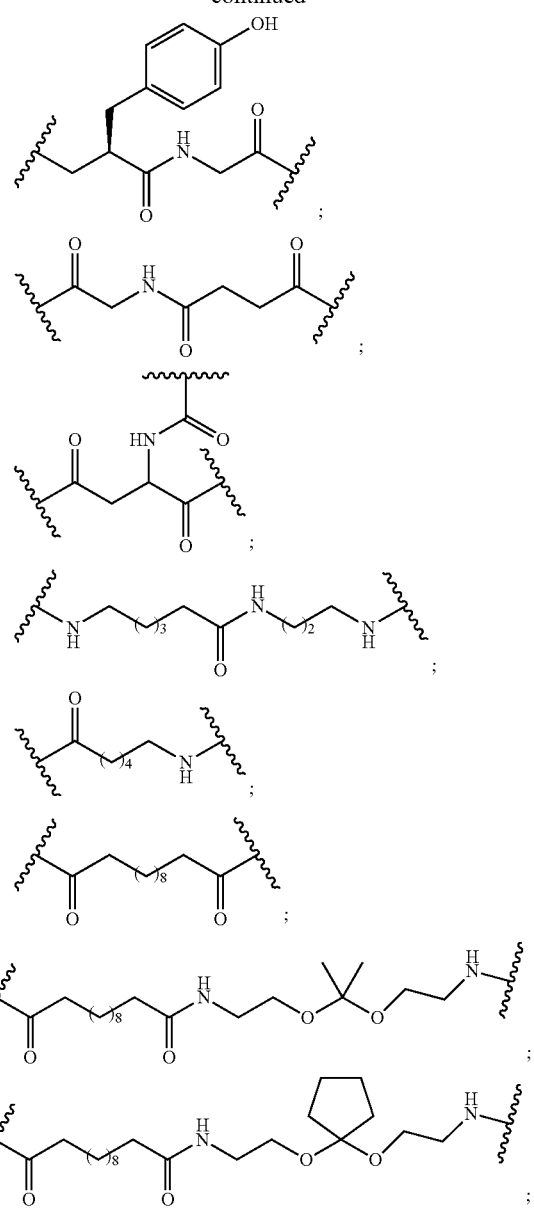

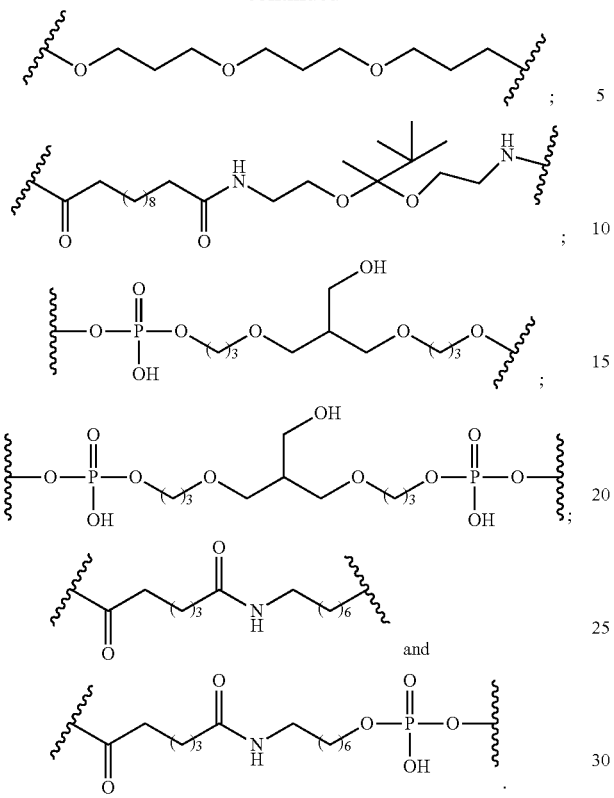
In certain embodiments, a linker has a structure selected from among:
In certain embodiments, a linker has a structure selected from among:
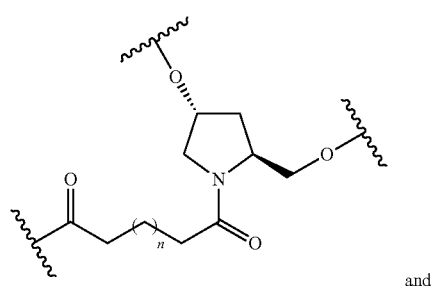
wherein n is from 1 to 20.
In certain embodiments, a linker has a structure selected from among:
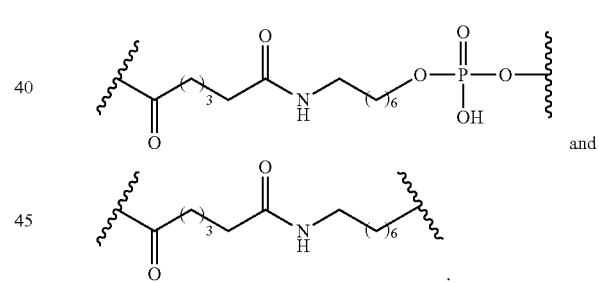
In certain embodiments, the conjugate linker has the structure:
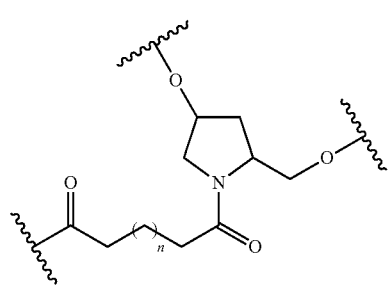
In certain embodiments, the conjugate linker has the structure:
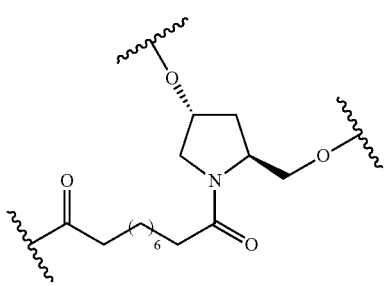

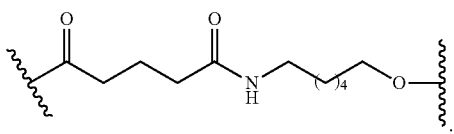

In certain embodiments, a linker has a structure selected from among:

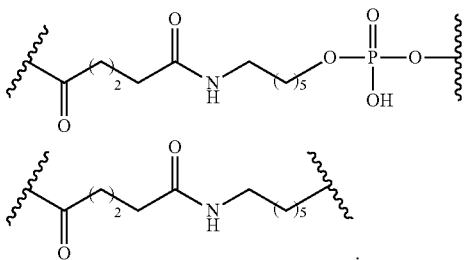

and

In certain embodiments, a linker has a structure selected from among:

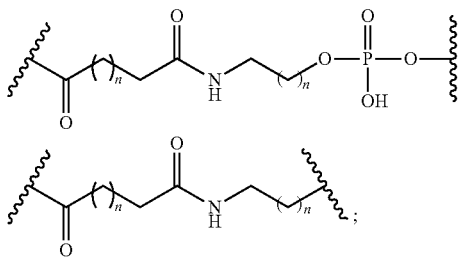

and wherein each n is independently, 0, 1, 2, 3, 4, 5, 6, or 7.

iii. Certain Cell-Targeting Moieties

In certain embodiments, conjugate groups comprise cell-targeting moieties. Certain such cell-targeting moieties increase cellular uptake of antisense compounds. In certain embodiments, cell-targeting moieties comprise a branching group, one or more tether, and one or more ligand. In certain embodiments, cell-targeting moieties comprise a branching group, one or more tether, one or more ligand and one or more cleavable bond.

1. Certain Branching Groups

In certain embodiments, the conjugate groups comprise a targeting moiety comprising a branching group and at least two tethered ligands. In certain embodiments, the branching group attaches the conjugate linker. In certain embodiments, the branching group attaches the cleavable moiety. In certain embodiments, the branching group attaches the antisense oligonucleotide. In certain embodiments, the branching group is covalently attached to the linker and each of the tethered ligands. In certain embodiments, the branching group comprises a branched aliphatic group comprising groups selected from alkyl, amide, disulfide, polyethylene glycol, ether, thioether and hydroxylamino groups. In certain embodiments, the branching group comprises groups selected from alkyl, amide and ether groups. In certain embodiments, the branching group comprises groups selected from alkyl and ether groups. In certain embodiments, the branching group comprises a mono or polycyclic ring system. In certain embodiments, the branching group comprises one or more cleavable bond. In certain embodiments, the conjugate group does not include a branching group.

In certain embodiments, a branching group has a structure selected from among:

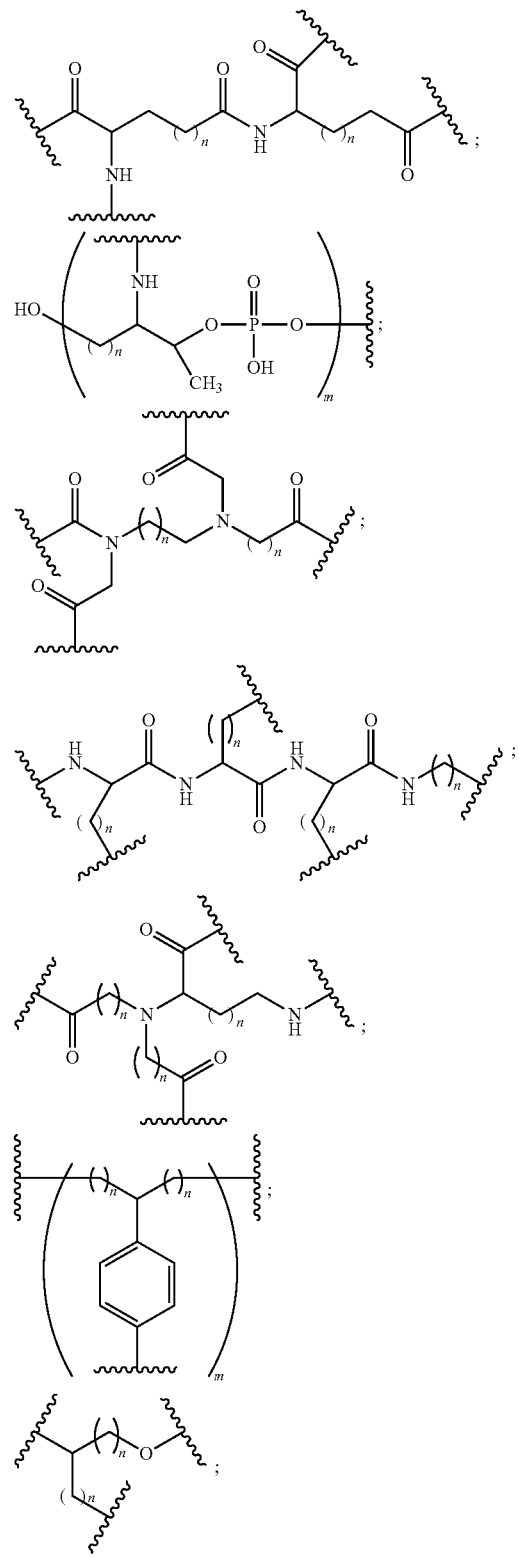

117
-continued
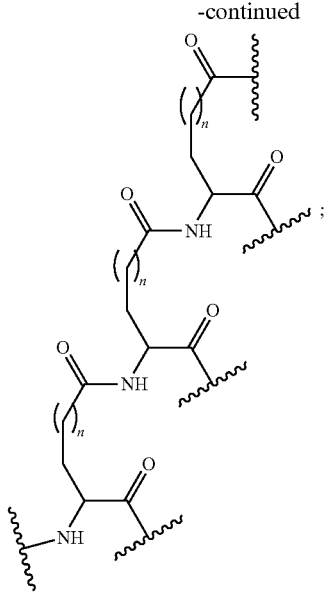
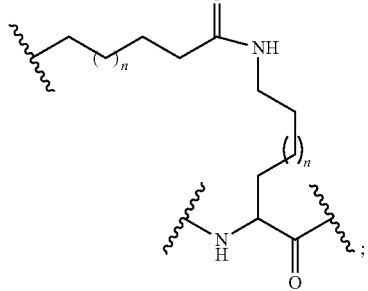
118
-continued
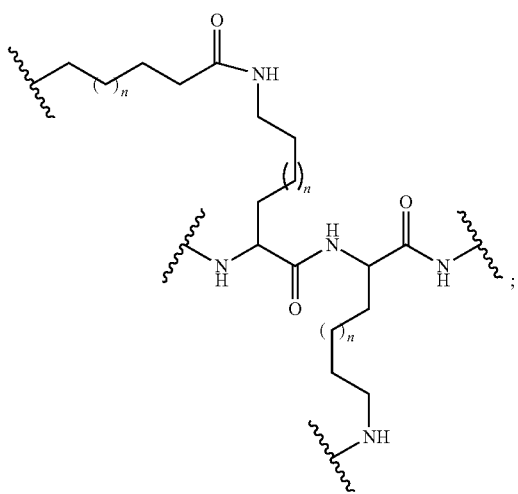
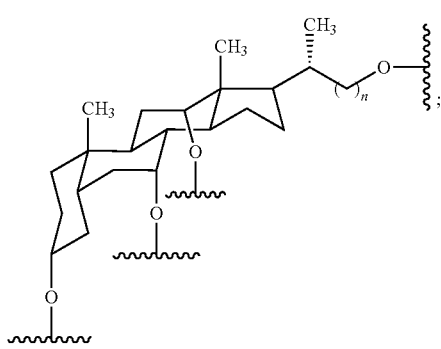
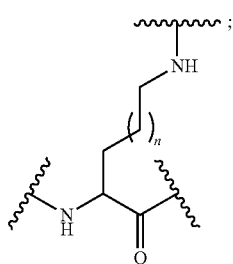
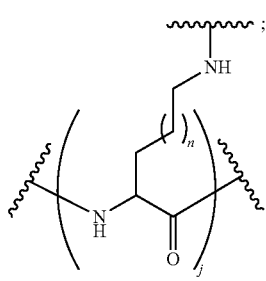
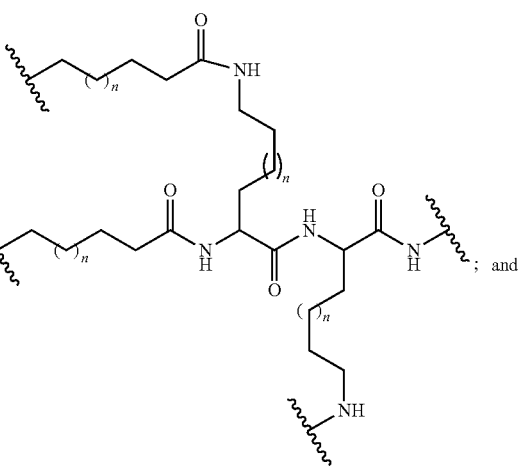
; and

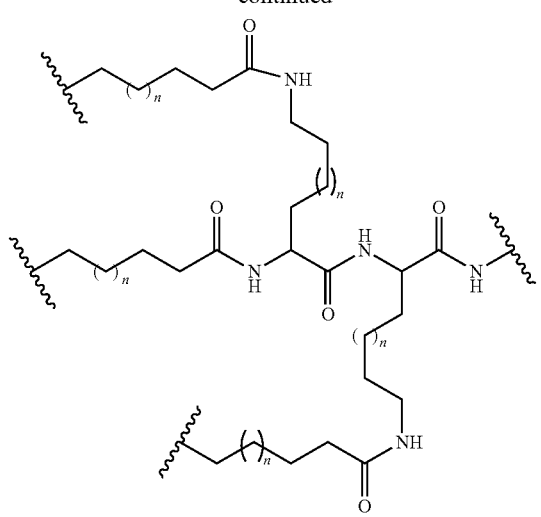
wherein each n is, independently, from 1 to 20;
j is from 1 to 3; and
m is from 2 to 6.
In certain embodiments, a branching group has a structure selected from among:
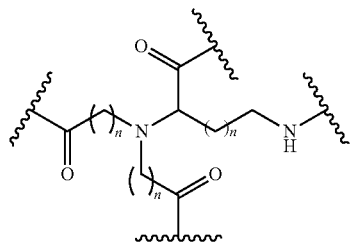
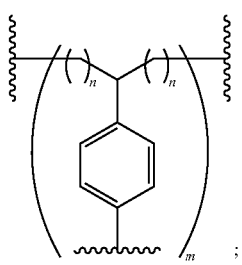
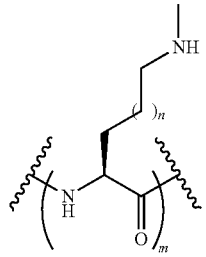
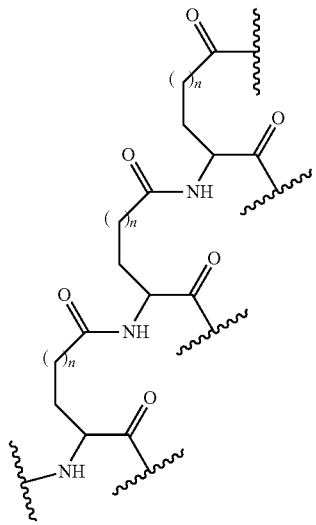
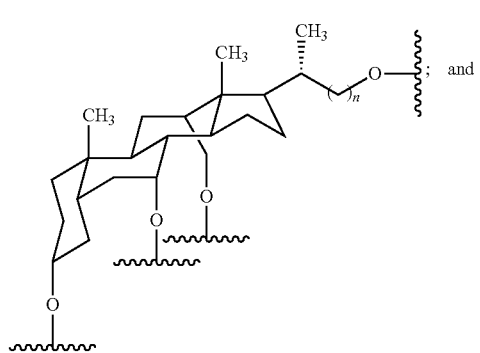

121
-continued
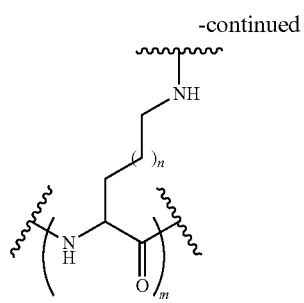
wherein each n is, independently, from 1 to 20; and m is from 2 to 6.
In certain embodiments, a branching group has a structure selected from among:
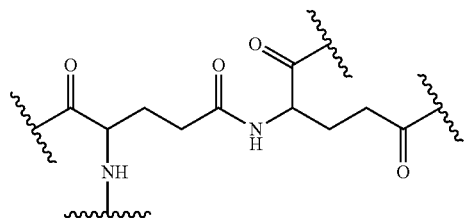
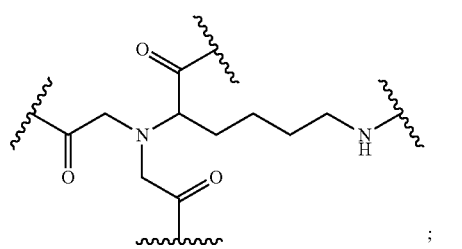
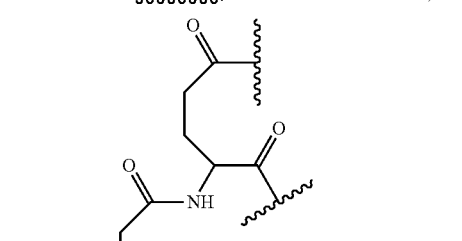
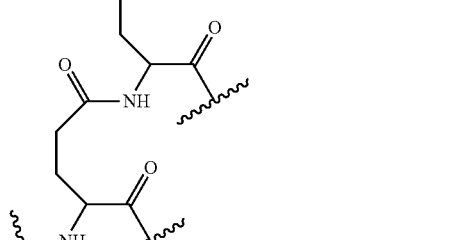
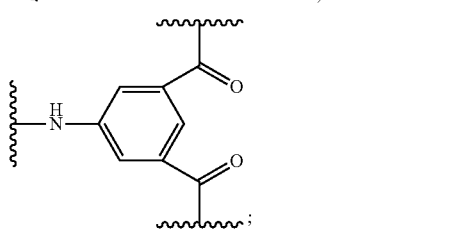
122
-continued
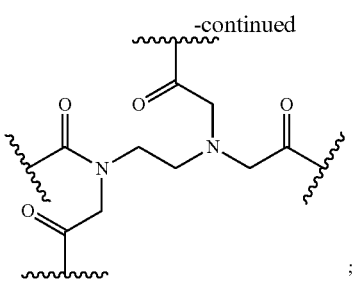
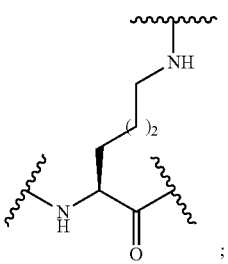
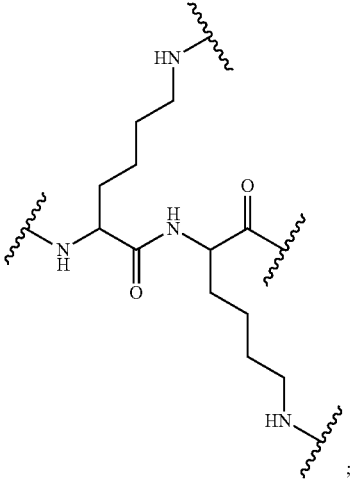
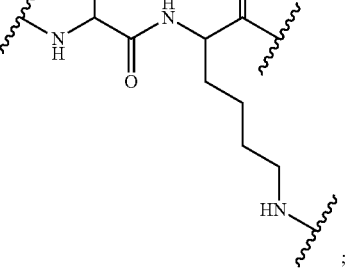
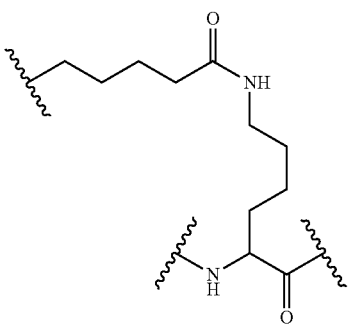

-continued

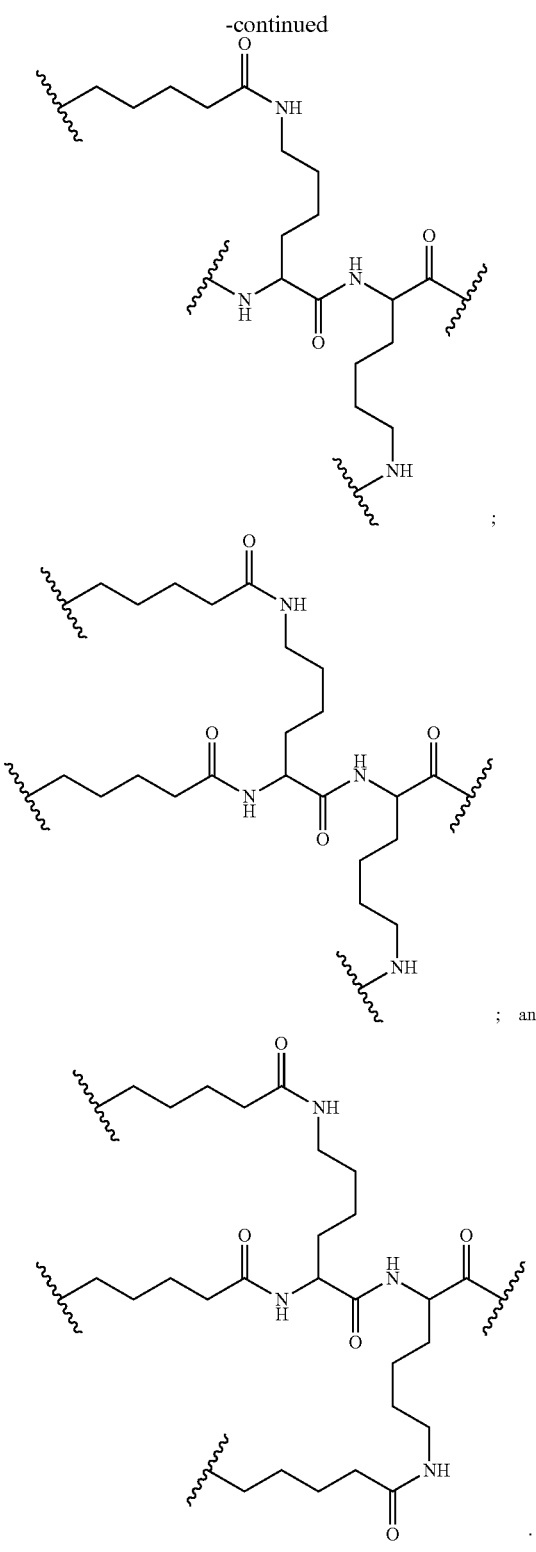

; and

In certain embodiments, a branching group has a structure selected from among:

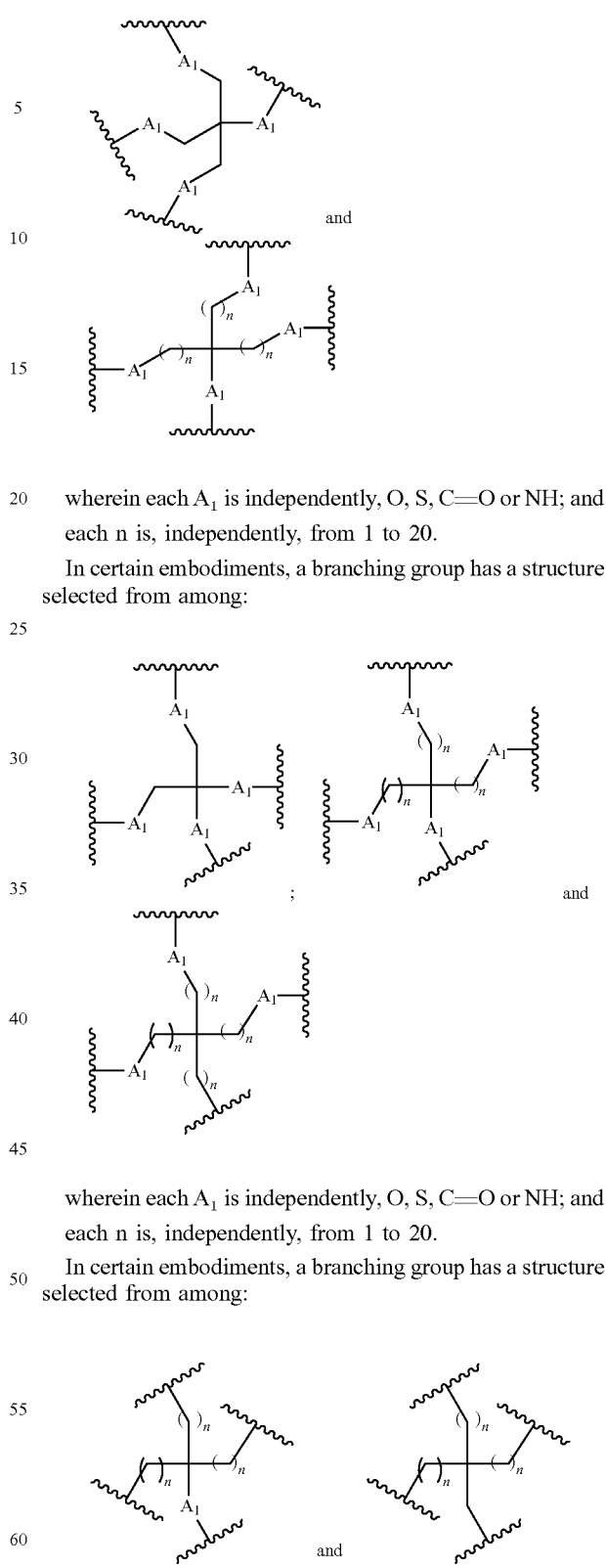

wherein each $A_1$ is independently, O, S, C=O or NH; and each n is, independently, from 1 to 20.

In certain embodiments, a branching group has a structure selected from among:

wherein each $A_1$ is independently, O, S, C=O or NH; and each n is, independently, from 1 to 20.

In certain embodiments, a branching group has a structure selected from among:

wherein $A_1$ is O, S, C=O or NH; and each n is, independently, from 1 to 20.

In certain embodiments, a branching group has a structure selected from among:

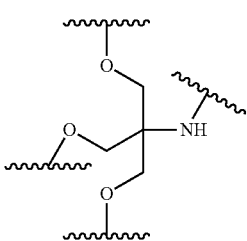

In certain embodiments, a branching group has a structure selected from among:

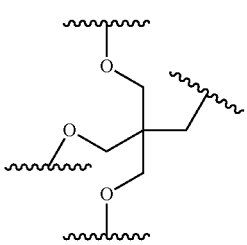

In certain embodiments, a branching group has a structure selected from among:

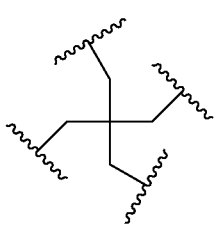

2. Certain Tethers

In certain embodiments, conjugate groups comprise one or more tethers covalently attached to the branching group. In certain embodiments, conjugate groups comprise one or more tethers covalently attached to the linking group. In certain embodiments, each tether is a linear aliphatic group comprising one or more groups selected from alkyl, ether, thioether, disulfide, amide and polyethylene glycol groups in any combination. In certain embodiments, each tether is a linear aliphatic group comprising one or more groups selected from alkyl, substituted alkyl, ether, thioether, disulfide, amide, phosphodiester and polyethylene glycol groups in any combination. In certain embodiments, each tether is a linear aliphatic group comprising one or more groups selected from alkyl, ether and amide groups in any combination. In certain embodiments, each tether is a linear aliphatic group comprising one or more groups selected from alkyl, substituted alkyl, phosphodiester, ether and amide groups in any combination. In certain embodiments, each tether is a linear aliphatic group comprising one or more groups selected from alkyl and phosphodiester in any combination. In certain embodiments, each tether comprises at least one phosphorus linking group or neutral linking group.

In certain embodiments, the tether includes one or more cleavable bond. In certain embodiments, the tether is attached to the branching group through either an amide or an ether group. In certain embodiments, the tether is attached to the branching group through a phosphodiester group. In certain embodiments, the tether is attached to the branching group through a phosphorus linking group or neutral linking group. In certain embodiments, the tether is attached to the branching group through an ether group. In certain embodiments, the tether is attached to the ligand through either an amide or an ether group. In certain embodiments, the tether is attached to the ligand through an ether group. In certain embodiments, the tether is attached to the ligand through either an amide or an ether group. In certain embodiments, the tether is attached to the ligand through an ether group.

In certain embodiments, each tether comprises from about 8 to about 20 atoms in chain length between the ligand and the branching group. In certain embodiments, each tether group comprises from about 10 to about 18 atoms in chain length between the ligand and the branching group. In certain embodiments, each tether group comprises about 13 atoms in chain length.

In certain embodiments, a tether has a structure selected from among:

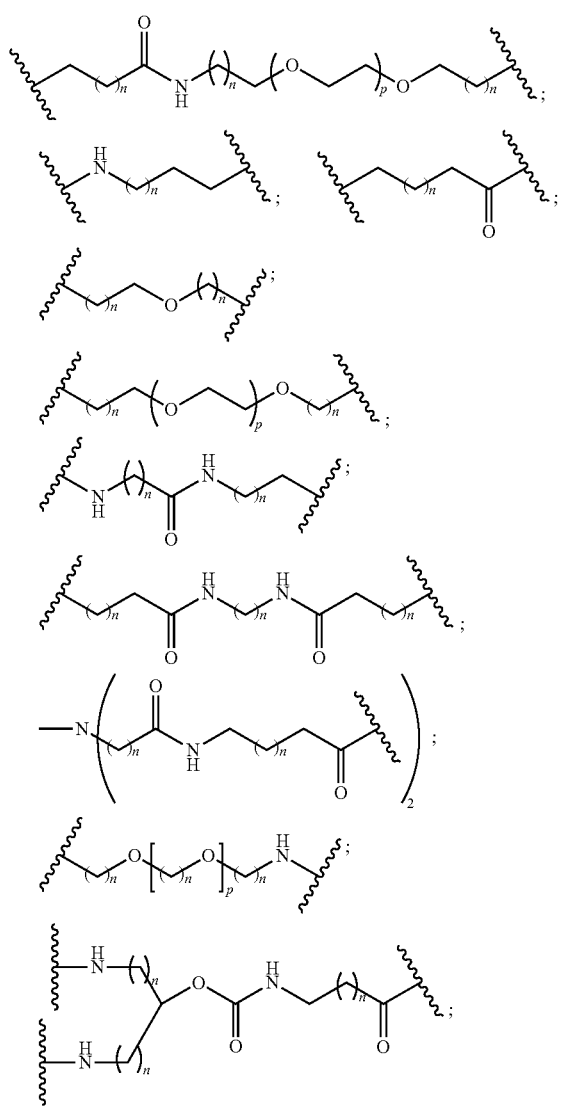

-continued

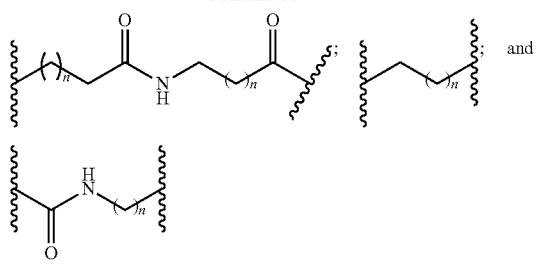

wherein each n is, independently, from 1 to 20; and each p is from 1 to about 6.

In certain embodiments, a tether has a structure selected from among:

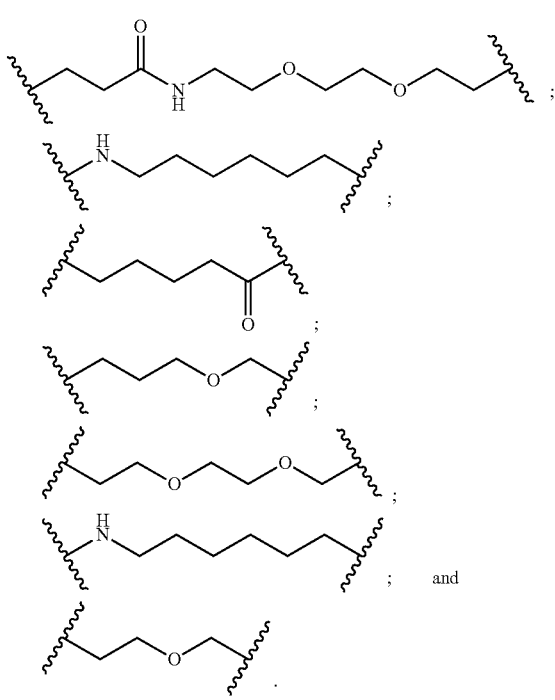

In certain embodiments, a tether has a structure selected from among:

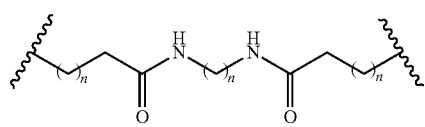

wherein each n is, independently, from 1 to 20.

In certain embodiments, a tether has a structure selected from among:

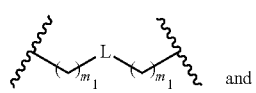

-continued

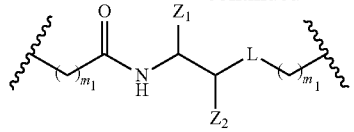

wherein L is either a phosphorus linking group or a neutral linking group;
$Z_1$ is $C(=O)O-R_2$;
$Z_2$ is H, $C_1$-$C_6$ alkyl or substituted $C_1$-$C_6$ alky;
$R_2$ is H, $C_1$-$C_6$ alkyl or substituted $C_1$-$C_6$ alky; and
each $m_1$ is, independently, from 0 to 20 wherein at least one $m_1$ is greater than 0 for each tether.

In certain embodiments, a tether has a structure selected from among:

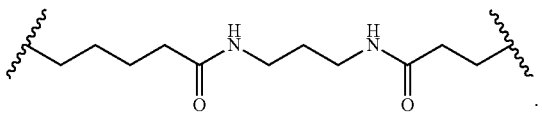 [SMILES: *CCCCC(=O)NCCCNC(=O)CC*]

In certain embodiments, a tether has a structure selected from among:

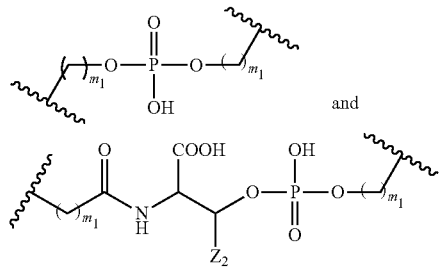

wherein $Z_2$ is H or $CH_3$; and
each $m_1$ is, independently, from 0 to 20 wherein at least one $m_1$ is greater than 0 for each tether.

In certain embodiments, a tether has a structure selected from among:

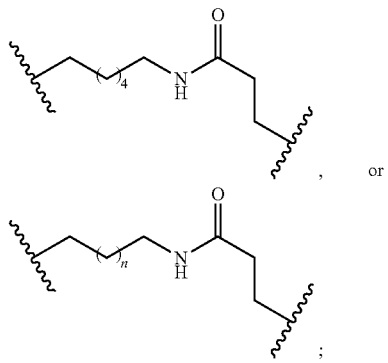

wherein each n is independently, 0, 1, 2, 3, 4, 5, 6, or 7.

In certain embodiments, a tether comprises a phosphorus linking group. In certain embodiments, a tether does not comprise any amide bonds. In certain embodiments, a tether comprises a phosphorus linking group and does not comprise any amide bonds.

3. Certain Ligands

In certain embodiments, the present disclosure provides ligands wherein each ligand is covalently attached to a tether. In certain embodiments, each ligand is selected to have an affinity for at least one type of receptor on a target cell. In certain embodiments, ligands are selected that have an affinity for at least one type of receptor on the surface of a mammalian liver cell. In certain embodiments, ligands are selected that have an affinity for the hepatic asialoglycoprotein receptor (ASGP-R). In certain embodiments, each ligand is a carbohydrate. In certain embodiments, each ligand is, independently selected from galactose, N-acetyl galactoseamine, mannose, glucose, glucosamone and fucose. In certain embodiments, each ligand is N-acetyl galactoseamine (GalNAc). In certain embodiments, the targeting moiety comprises 2 to 6 ligands. In certain embodiments, the targeting moiety comprises 3 ligands. In certain embodiments, the targeting moiety comprises 3 N-acetyl galactoseamine ligands.

In certain embodiments, the ligand is a carbohydrate, carbohydrate derivative, modified carbohydrate, multivalent carbohydrate cluster, polysaccharide, modified polysaccharide, or polysaccharide derivative. In certain embodiments, the ligand is an amino sugar or a thio sugar. For example, amino sugars may be selected from any number of compounds known in the art, for example glucosamine, sialic acid, α-D-galactosamine, N-Acetylgalactosamine, 2-acetamido-2-deoxy-D-galactopyranose (GalNAc), 2-Amino-3-O—[(R)-1-carboxyethyl]-2-deoxy-β-D-glucopyranose (β-muramic acid), 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose and N-sulfo-D-glucosamine, and N-Glycoloyl-α-neuraminic acid. For example, thio sugars may be selected from the group consisting of 5-Thio-β-D-glucopyranose, Methyl 2,3, 4-tri-O-acetyl-1-thio-6-O-trityl-α-D-glucopyranoside, 4-Thio-β-D-galactopyranose, and ethyl 3,4,6,7-tetra-O-acetyl-2-deoxy-1,5-dithio-α-D-gluco-heptopyranoside.

In certain embodiments, "GalNAc" or "Gal-NAc" refers to 2-(Acetylamino)-2-deoxy-D-galactopyranose, commonly referred to in the literature as N-acetyl galactosamine. In certain embodiments, "N-acetyl galactosamine" refers to 2-(Acetylamino)-2-deoxy-D-galactopyranose. In certain embodiments, "GalNAc" or "Gal-NAc" refers to 2-(Acetylamino)-2-deoxy-D-galactopyranose. In certain embodiments, "GalNAc" or "Gal-NAc" refers to 2-(Acetylamino)-2-deoxy-D-galactopyranose, which includes both the β-form: 2-(Acetylamino)-2-deoxy-β-D-galactopyranose and α-form: 2-(Acetylamino)-2-deoxy-D-galactopyranose. In certain embodiments, both the β-form: 2-(Acetylamino)-2-deoxy-β-D-galactopyranose and α-form: 2-(Acetylamino)-2-deoxy-D-galactopyranose may be used interchangeably. Accordingly, in structures in which one form is depicted, these structures are intended to include the other form as well. For example, where the structure for an α-form: 2-(Acetylamino)-2-deoxy-D-galactopyranose is shown, this structure is intended to include the other form as well. In certain embodiments, In certain preferred embodiments, the β-form 2-(Acetylamino)-2-deoxy-D-galactopyranose is the preferred embodiment.

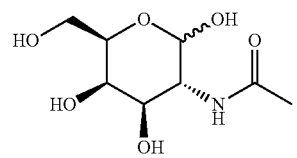

2-(Acetylamino)-2-deoxy-D-galactopyranose

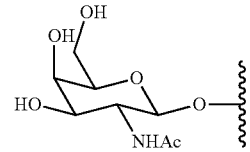

2-(Acetylamino)-2-deoxy-β-D-galactopyranose

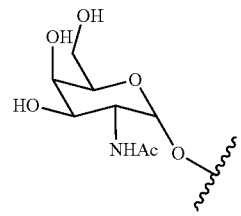

2-(Acetylamino)-2-deoxy-α-D-galactopyranose

In certain embodiments one or more ligand has a structure selected from among:

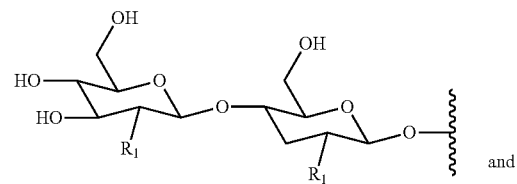

and

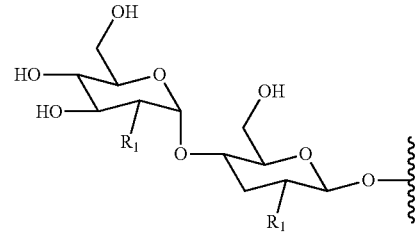

wherein each $R_1$ is selected from OH and NHCOOH.

In certain embodiments one or more ligand has a structure selected from among:

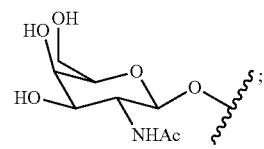

;

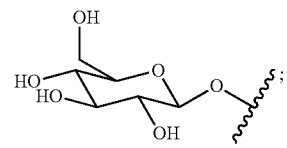

;

-continued

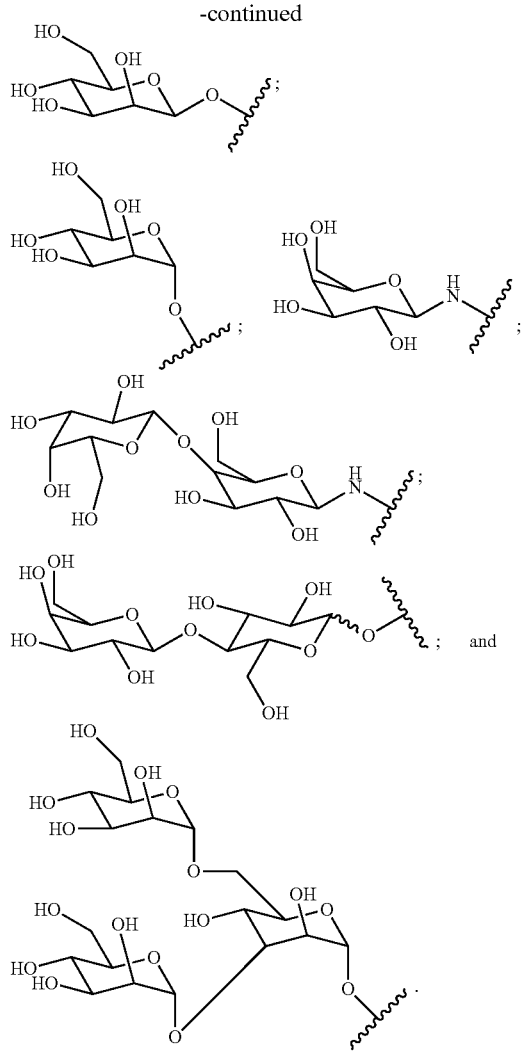

In certain embodiments one or more ligand has a structure selected from among:

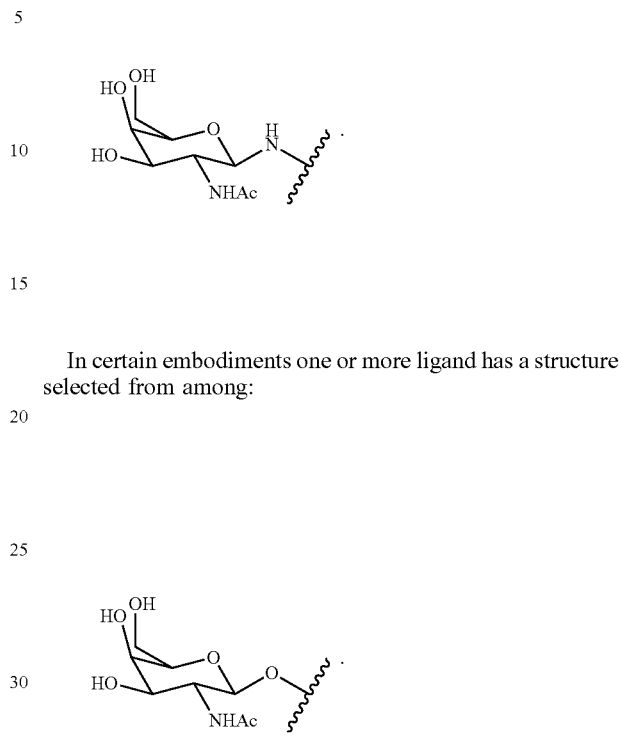

In certain embodiments one or more ligand has a structure selected from among:

i. Certain Conjugates

In certain embodiments, conjugate groups comprise the structural features above. In certain such embodiments, conjugate groups have the following structure:

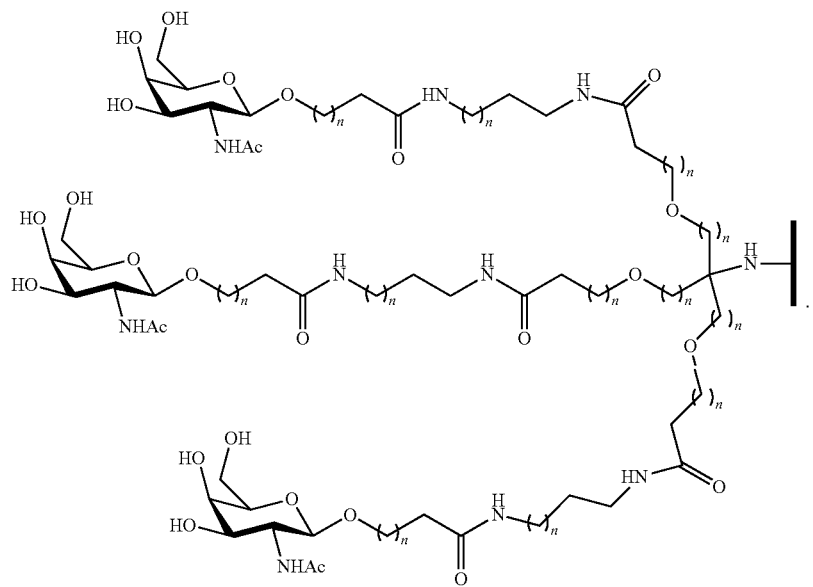

wherein each n is, independently, from 1 to 20.

In certain such embodiments, conjugate groups have the following structure:

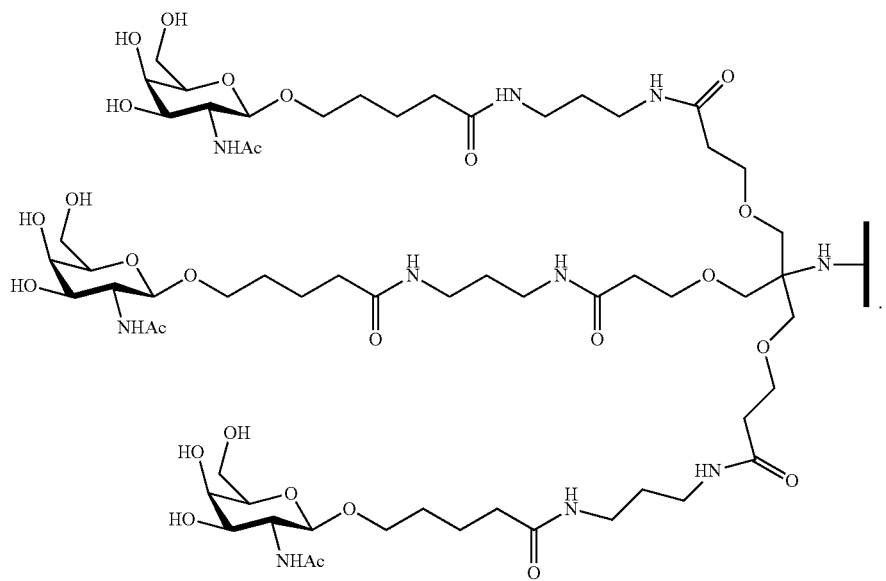

In certain such embodiments, conjugate groups have the following structure:

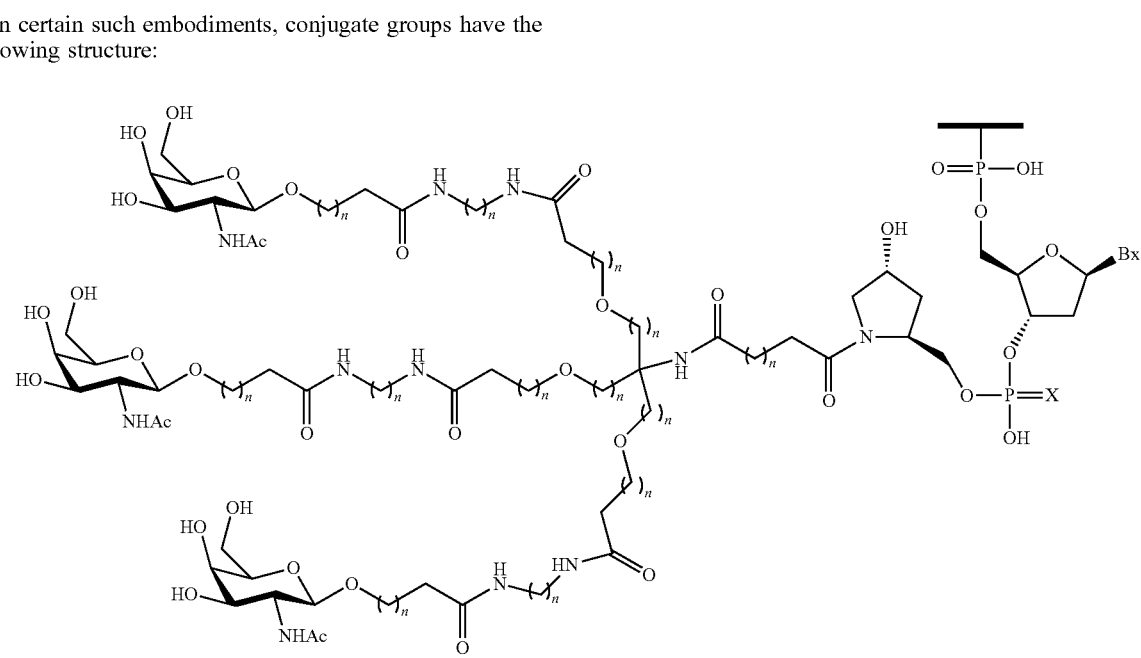

wherein each n is, independently, from 1 to 20;
Z is H or a linked solid support;
Q is an antisense compound;
X is O or S; and
Bx is a heterocyclic base moiety.

In certain such embodiments, conjugate groups have the following structure:

135
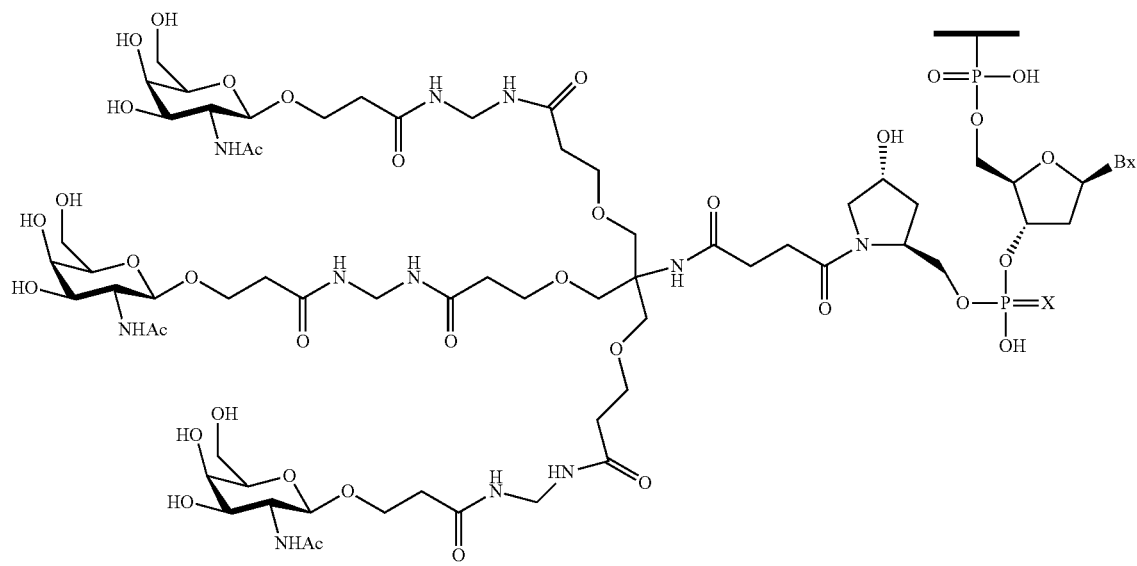
In certain such embodiments, conjugate groups have the following structure:
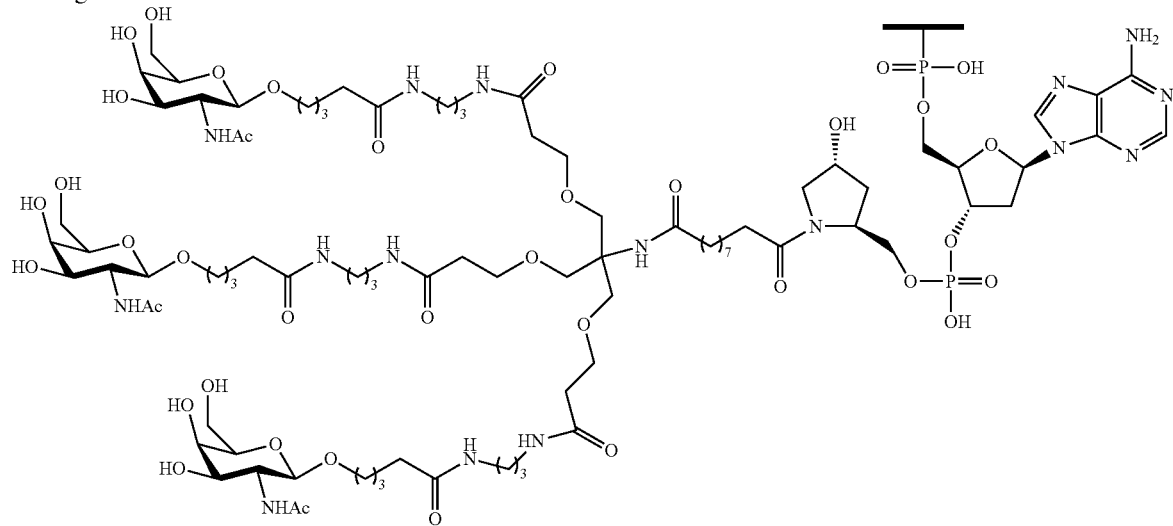
In certain such embodiments, conjugate groups have the following structure:
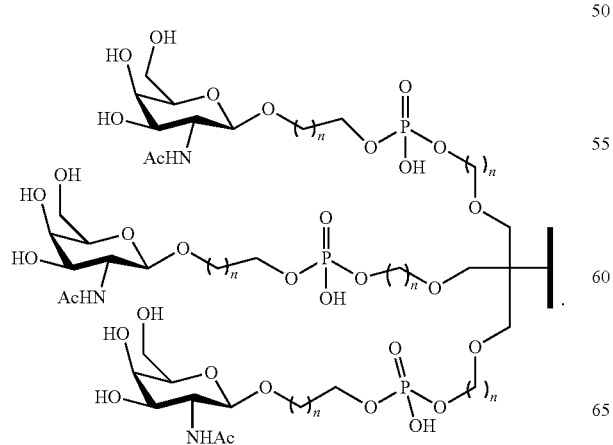

In certain such embodiments, conjugate groups have the following structure:
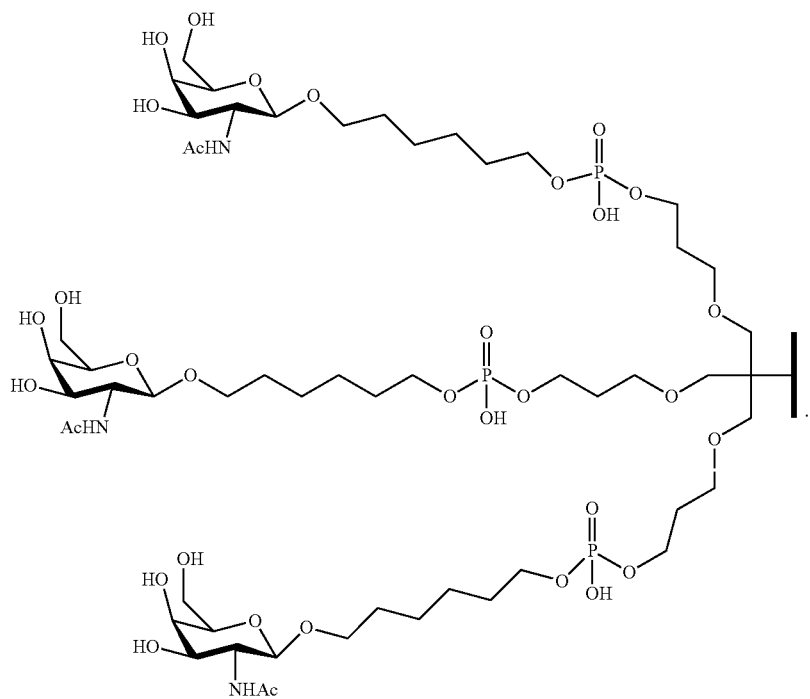
In certain such embodiments, conjugate groups have the following structure:
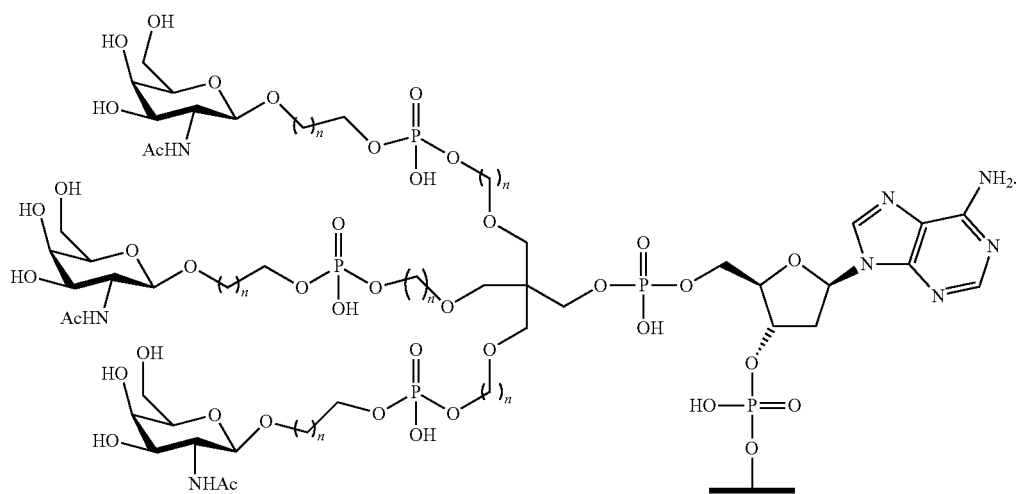
In certain such embodiments, conjugate groups have the following structure:

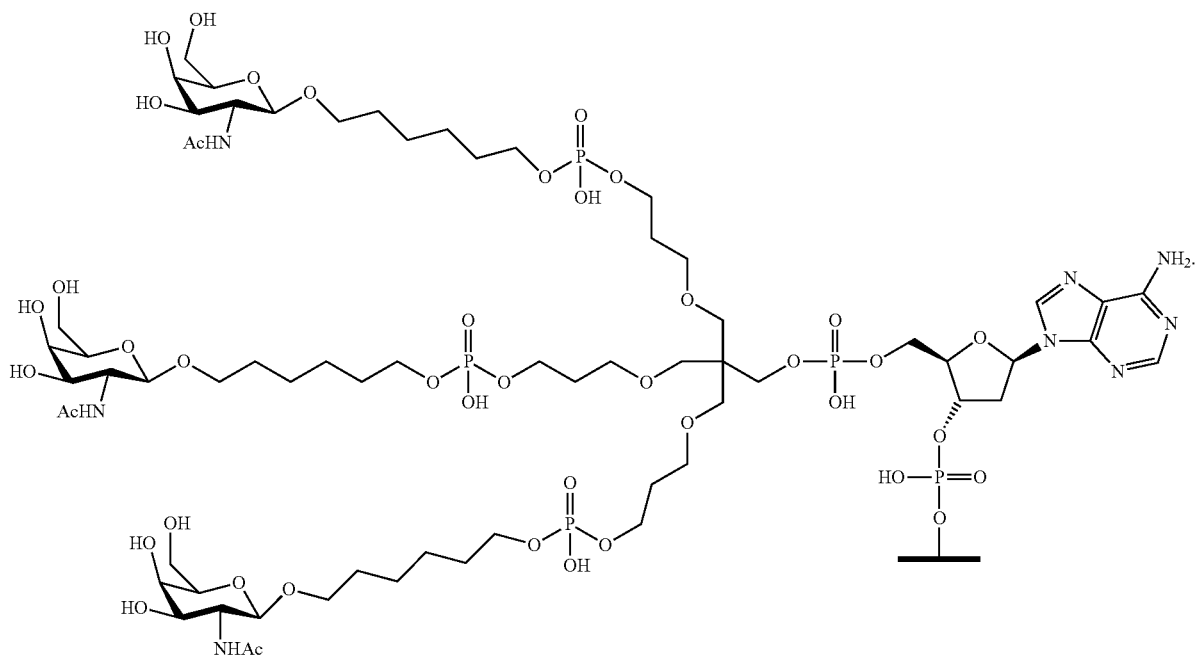
In certain such embodiments, conjugate groups have the following structure:
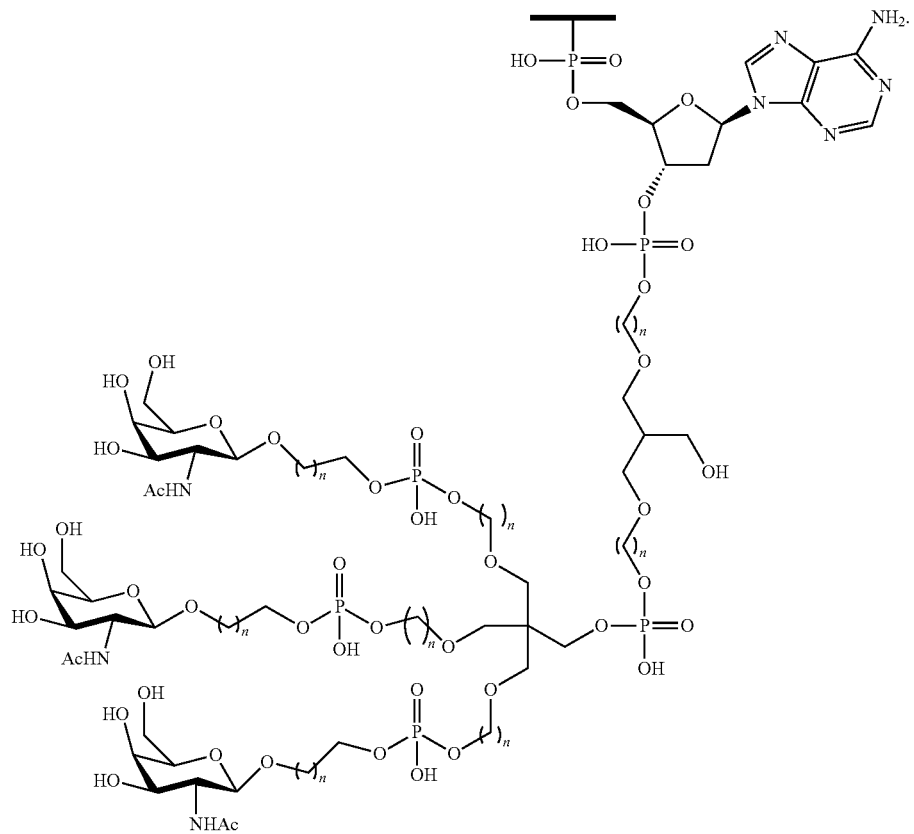
In certain such embodiments, conjugate groups have the following structure:

141
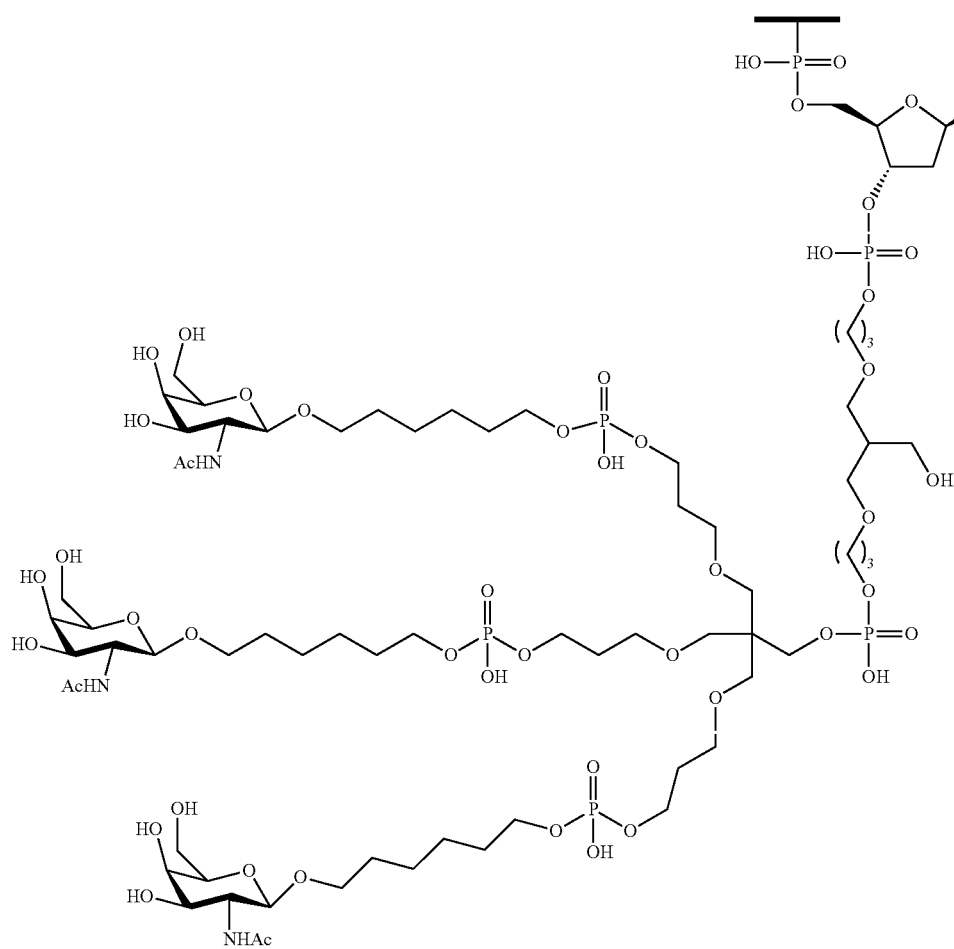
In certain embodiments, conjugates do not comprise a pyrrolidine.
142
In certain such embodiments, conjugate groups have the following structure:
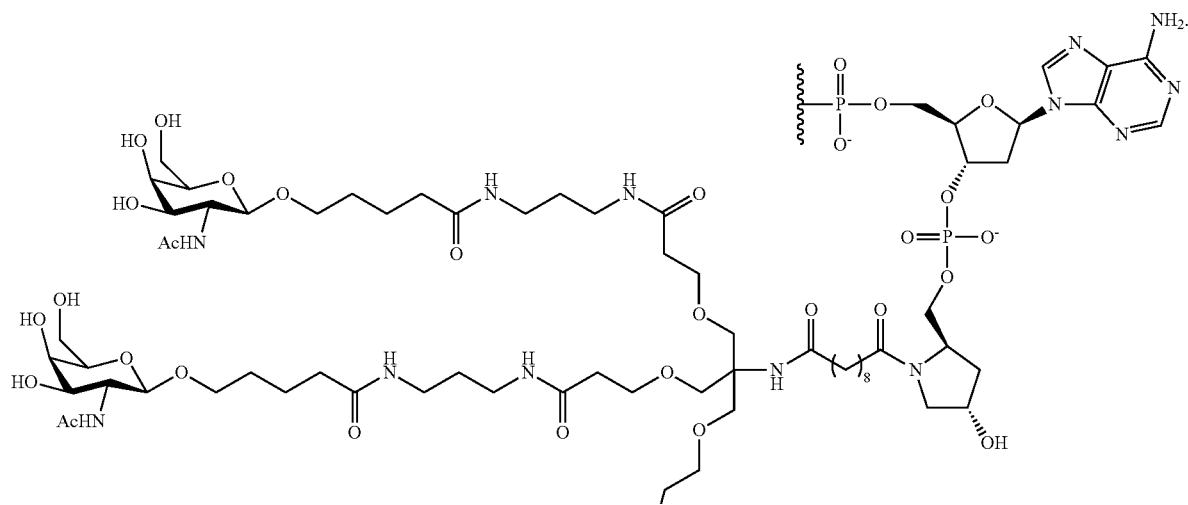

-continued
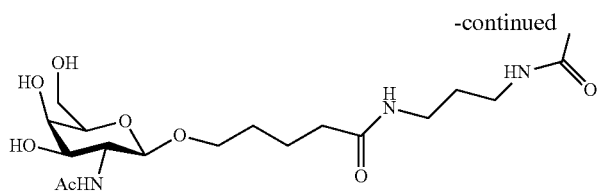
In certain such embodiments, conjugate groups have the following structure:
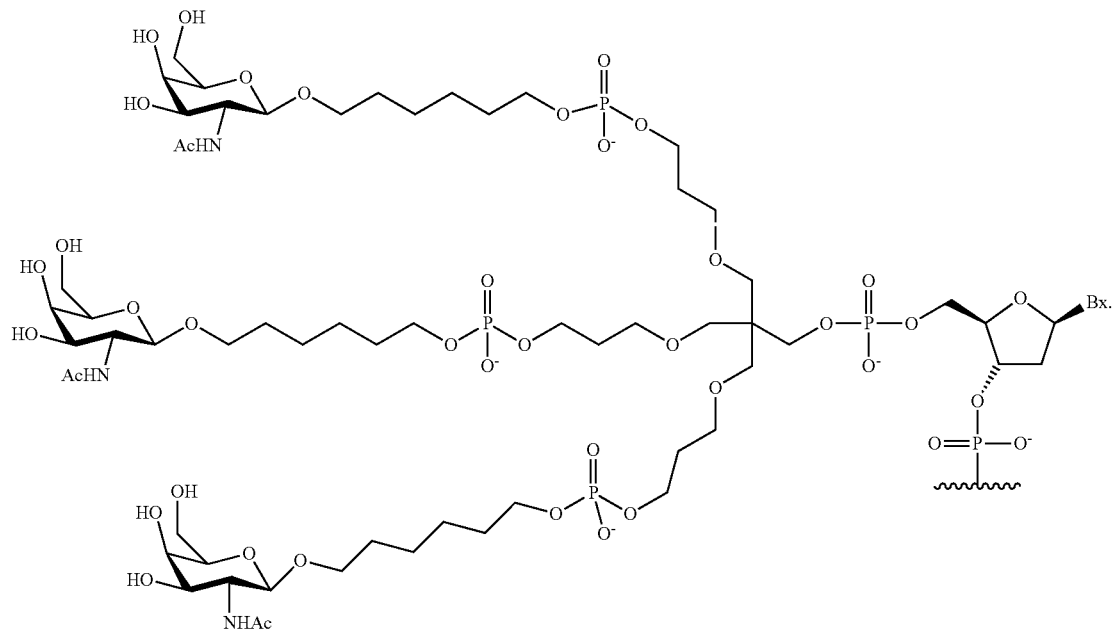
In certain such embodiments, conjugate groups have the following structure:
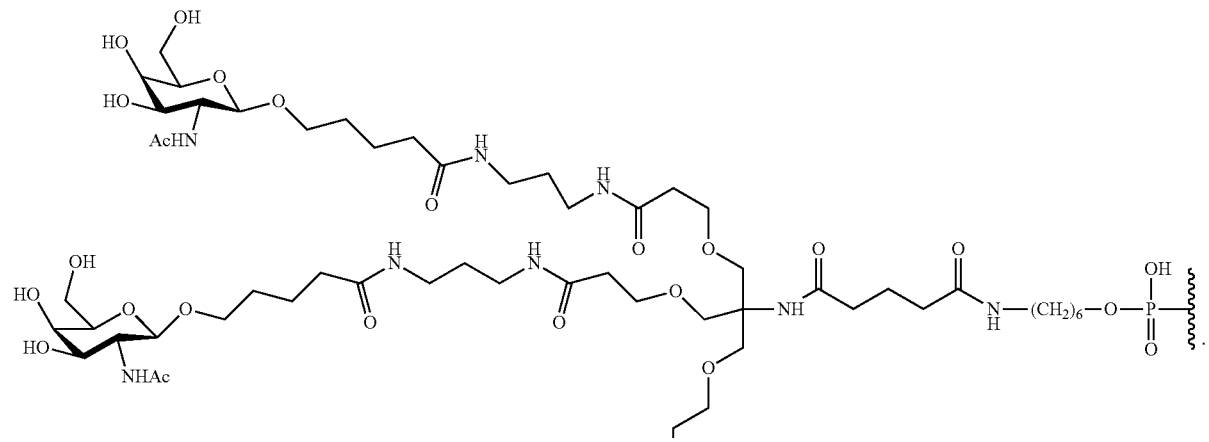

-continued
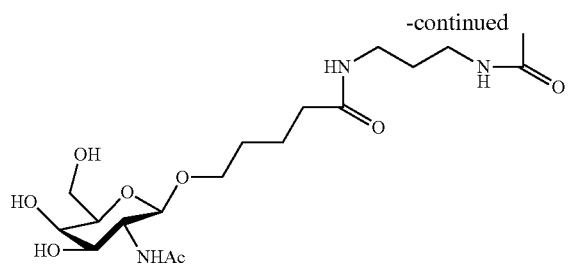
In certain such embodiments, conjugate groups have the following structure:
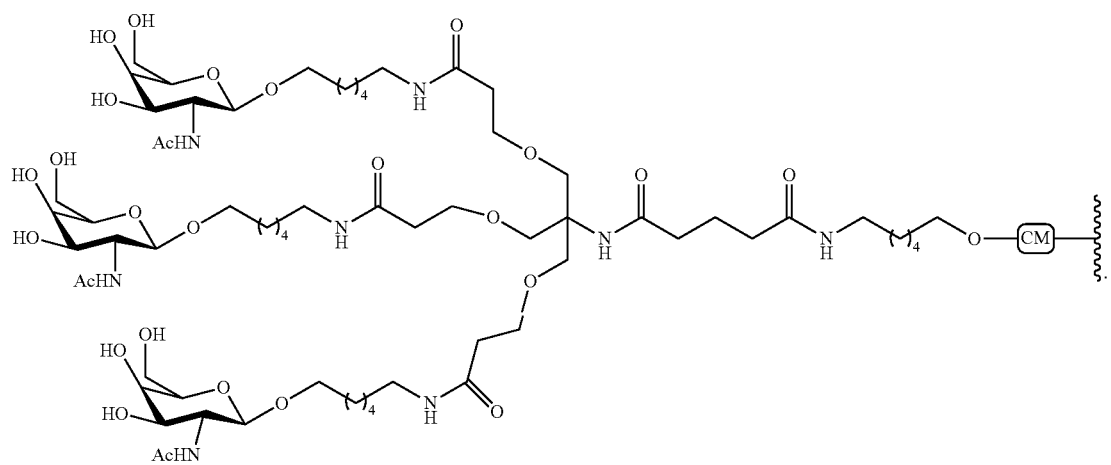
In certain such embodiments, conjugate groups have the following structure:
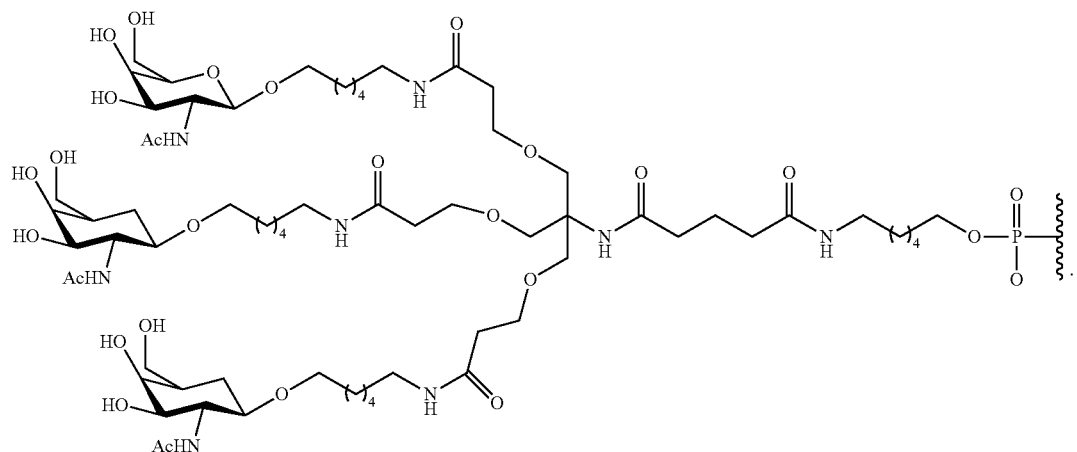
In certain such embodiments, conjugate groups have the following structure:

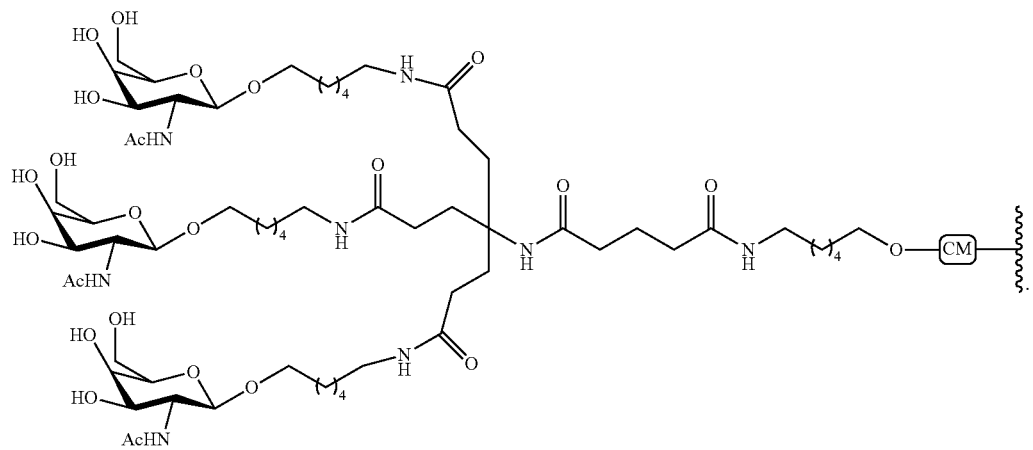
In certain such embodiments, conjugate groups have the following structure:
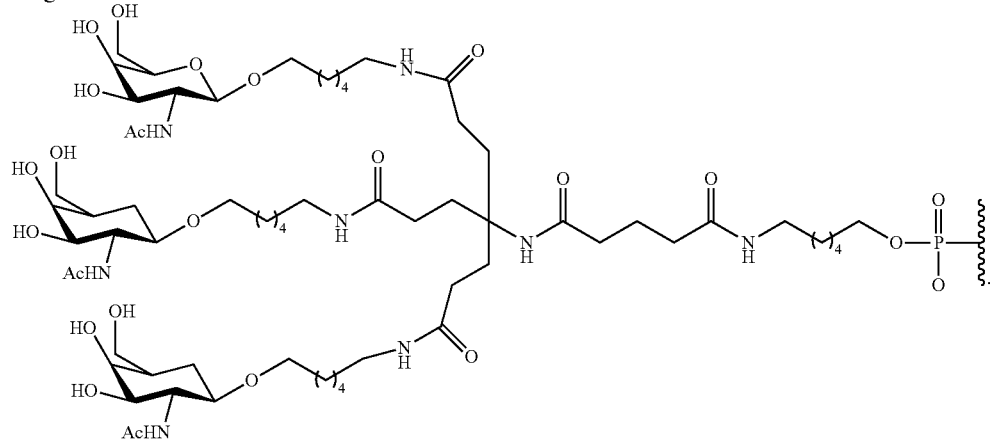
In certain such embodiments, conjugate groups have the following structure:
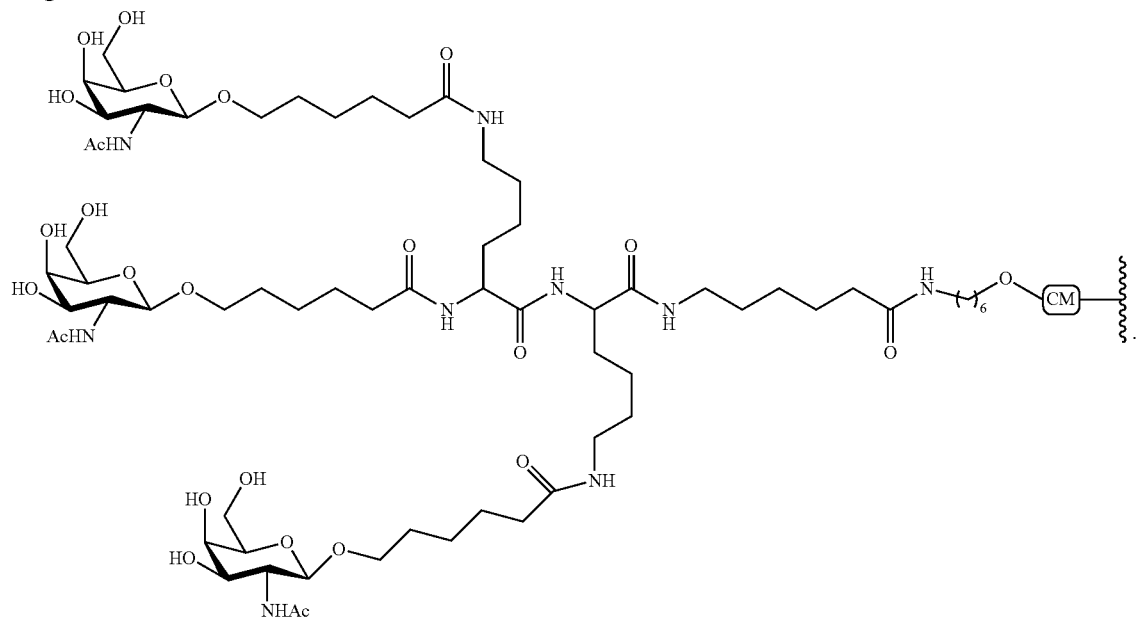

In certain such embodiments, conjugate groups have the following structure:
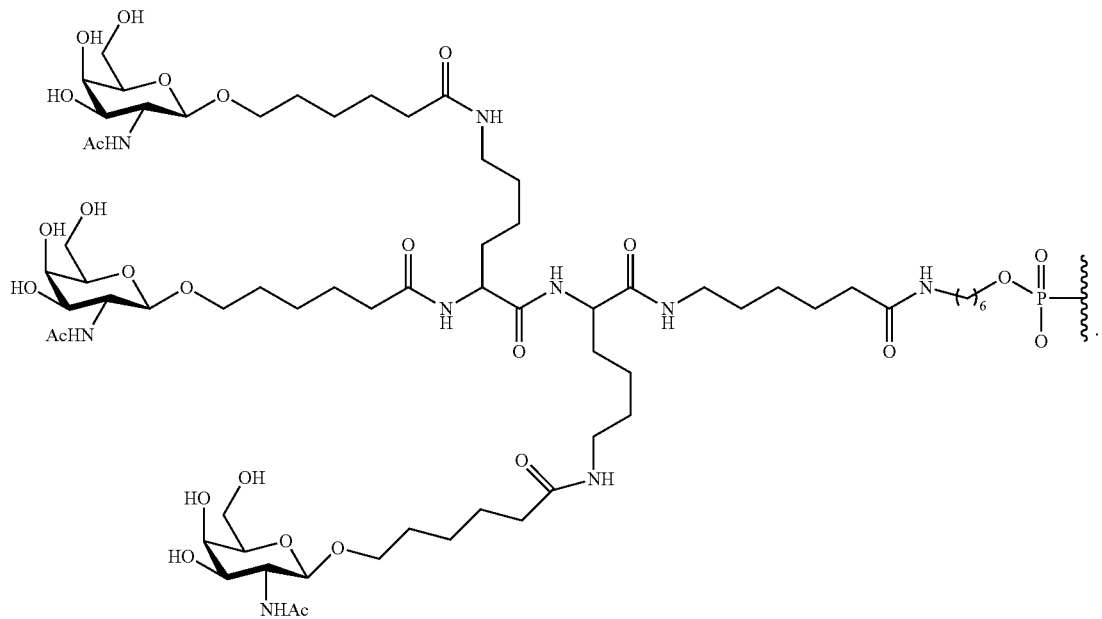
In certain such embodiments, conjugate groups have the following structure:
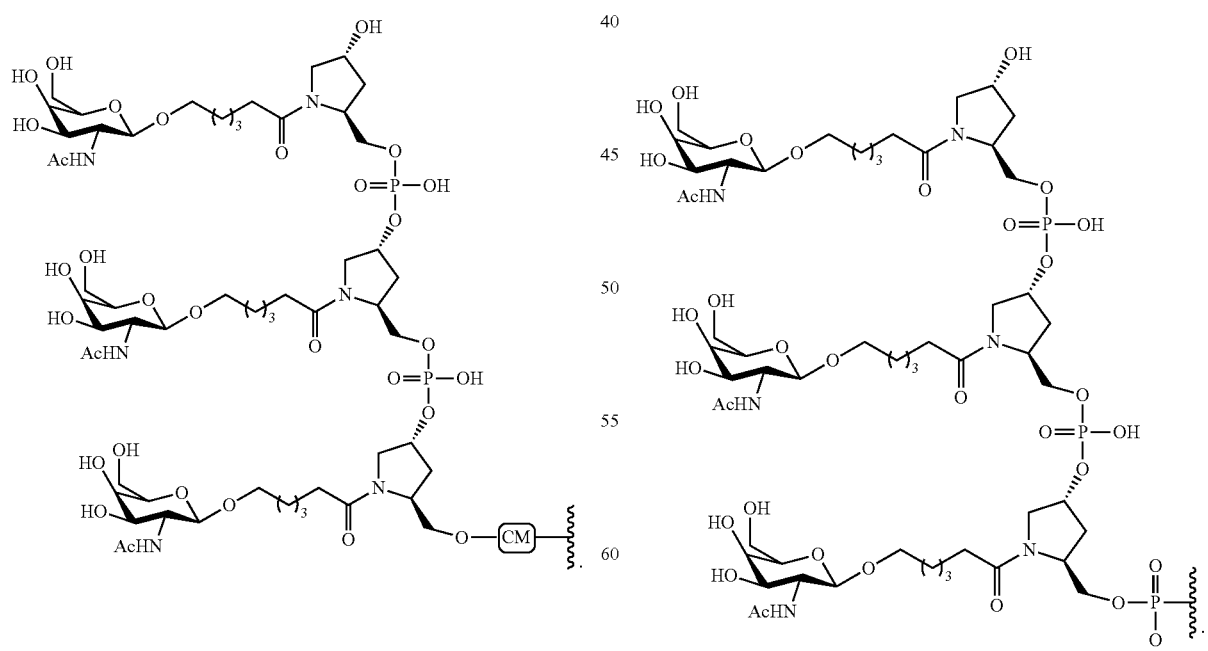
In certain such embodiments, conjugate groups have the following structure:
In certain embodiments, the cell-targeting moiety of the conjugate group has the following structure:

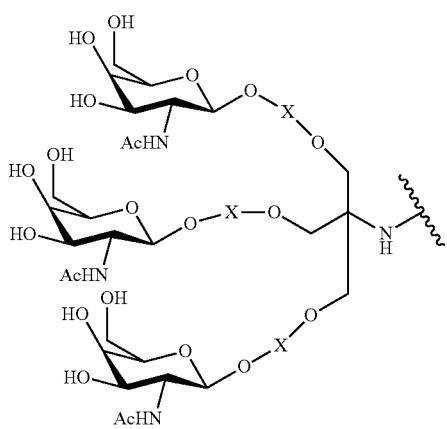

wherein X is a substituted or unsubstituted tether of six to eleven consecutively bonded atoms.

In certain embodiments, the cell-targeting moiety of the conjugate group has the following structure:

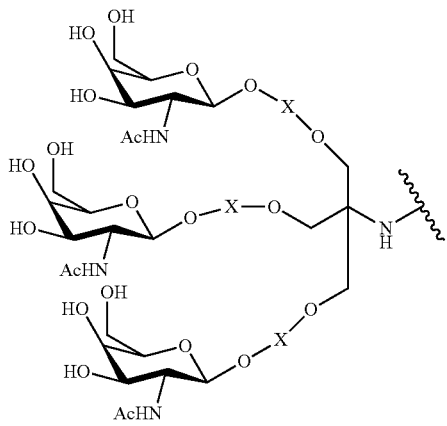

wherein X is a substituted or unsubstituted tether of ten consecutively bonded atoms.

In certain embodiments, the cell-targeting moiety of the conjugate group has the following structure:

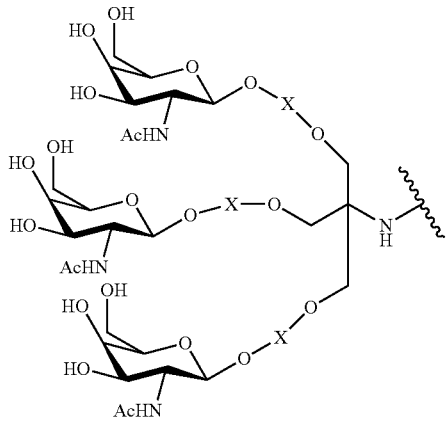

wherein X is a substituted or unsubstituted tether of four to eleven consecutively bonded atoms and wherein the tether comprises exactly one amide bond.

In certain embodiments, the cell-targeting moiety of the conjugate group has the following structure:

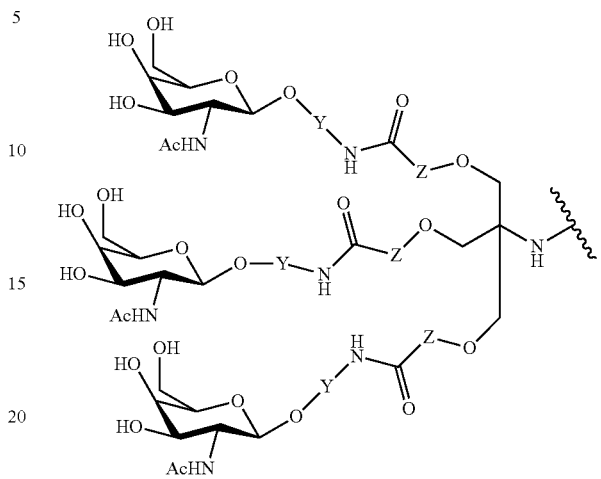

wherein Y and Z are independently selected from a $C_1$-$C_{12}$ substituted or unsubstituted alkyl, alkenyl, or alkynyl group, or a group comprising an ether, a ketone, an amide, an ester, a carbamate, an amine, a piperidine, a phosphate, a phosphodiester, a phosphorothioate, a triazole, a pyrrolidine, a disulfide, or a thioether.

In certain such embodiments, the cell-targeting moiety of the conjugate group has the following structure:

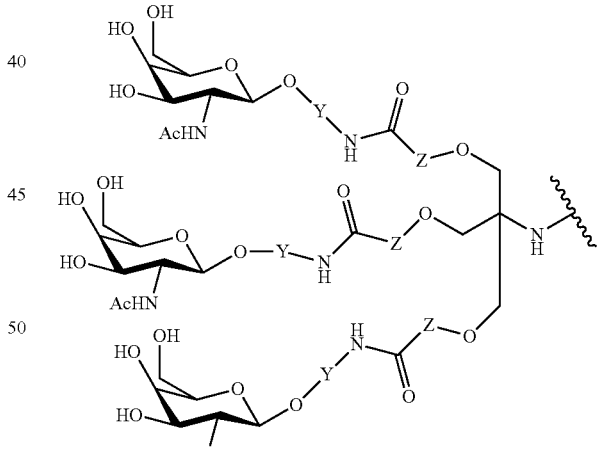

wherein Y and Z are independently selected from a $C_1$-$C_{12}$ substituted or unsubstituted alkyl group, or a group comprising exactly one ether or exactly two ethers, an amide, an amine, a piperidine, a phosphate, a phosphodiester, or a phosphorothioate.

In certain such embodiments, the cell-targeting moiety of the conjugate group has the following structure:

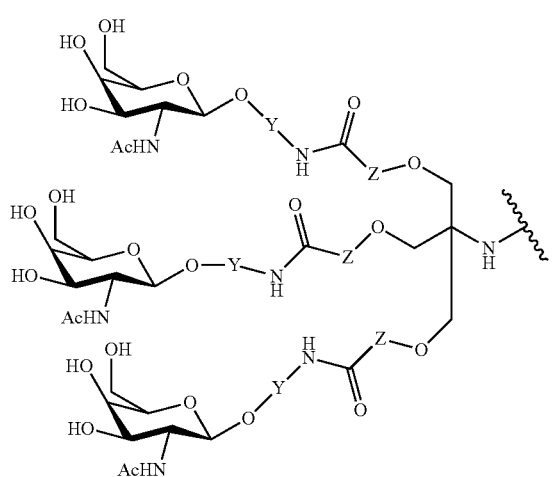

wherein Y and Z are independently selected from a $C_1$-$C_{12}$ substituted or unsubstituted alkyl group.

In certain such embodiments, the cell-targeting moiety of the conjugate group has the following structure:

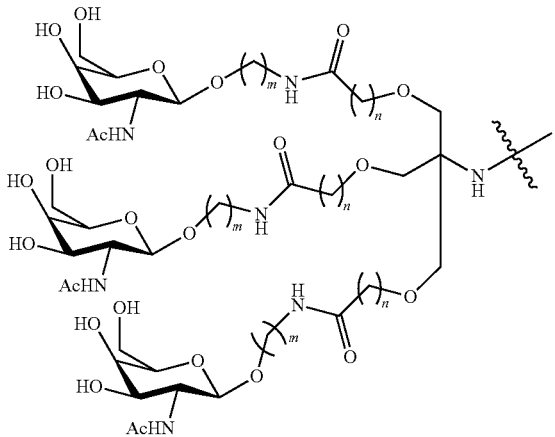

wherein m and n are independently selected from 1, 2, 3, 4, 5, 6, 7, 8, 9, 10, 11, and 12.

In certain such embodiments, the cell-targeting moiety of the conjugate group has the following structure:

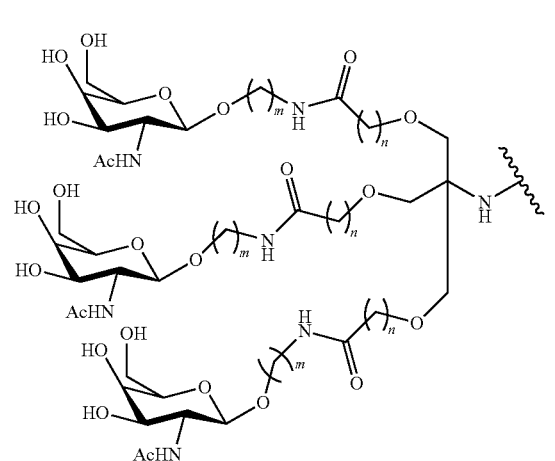

wherein m is 4, 5, 6, 7, or 8, and n is 1, 2, 3, or 4.

In certain embodiments, the cell-targeting moiety of the conjugate group has the following structure:

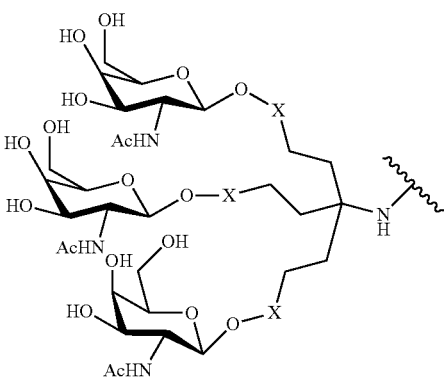

wherein X is a substituted or unsubstituted tether of four to thirteen consecutively bonded atoms, and wherein X does not comprise an ether group.

In certain embodiments, the cell-targeting moiety of the conjugate group has the following structure:

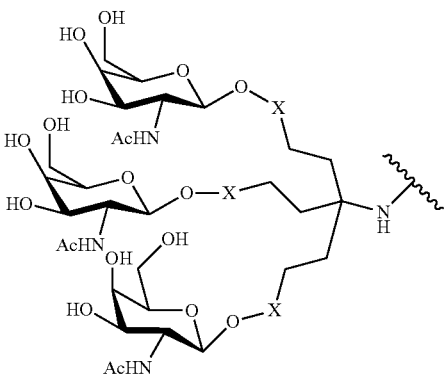

wherein X is a substituted or unsubstituted tether of eight consecutively bonded atoms, and wherein X does not comprise an ether group.

In certain embodiments, the cell-targeting moiety of the conjugate group has the following structure:

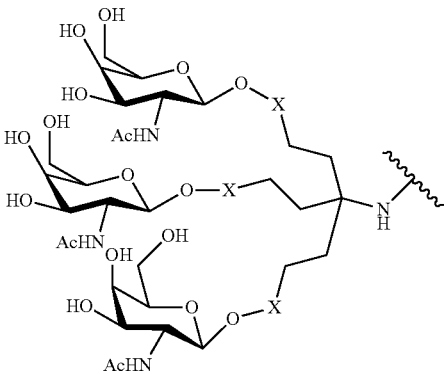

wherein X is a substituted or unsubstituted tether of four to thirteen consecutively bonded atoms, and wherein the tether comprises exactly one amide bond, and wherein X does not comprise an ether group.

In certain embodiments, the cell-targeting moiety of the conjugate group has the following structure:

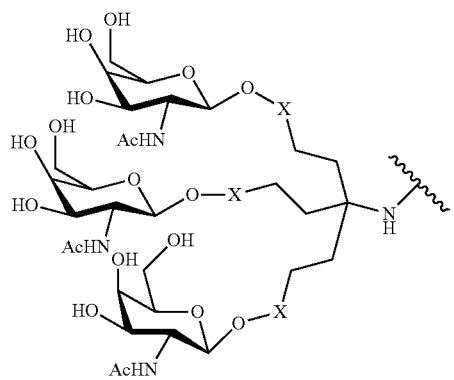

wherein X is a substituted or unsubstituted tether of four to thirteen consecutively bonded atoms and wherein the tether consists of an amide bond and a substituted or unsubstituted $C_2$-$C_{11}$ alkyl group.

In certain embodiments, the cell-targeting moiety of the conjugate group has the following structure:

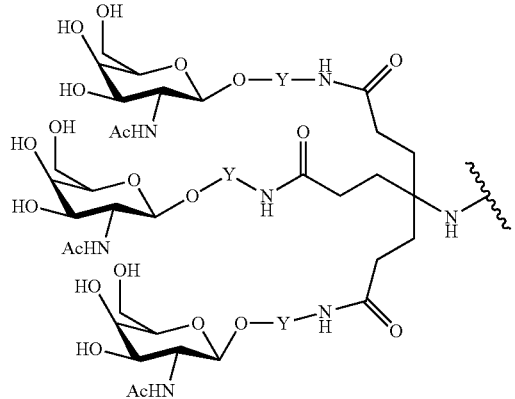

wherein Y is selected from a $C_1$-$C_{12}$ substituted or unsubstituted alkyl, alkenyl, or alkynyl group, or a group comprising an ether, a ketone, an amide, an ester, a carbamate, an amine, a piperidine, a phosphate, a phosphodiester, a phosphorothioate, a triazole, a pyrrolidine, a disulfide, or a thioether.

In certain such embodiments, the cell-targeting moiety of the conjugate group has the following structure:

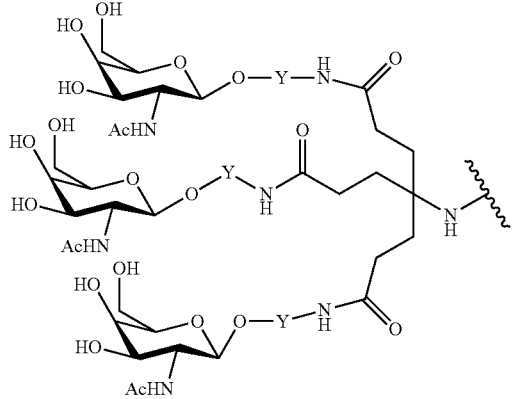

wherein Y is selected from a $C_1$-$C_{12}$ substituted or unsubstituted alkyl group, or a group comprising an ether, an amine, a piperidine, a phosphate, a phosphodiester, or a phosphorothioate.

In certain such embodiments, the cell-targeting moiety of the conjugate group has the following structure:

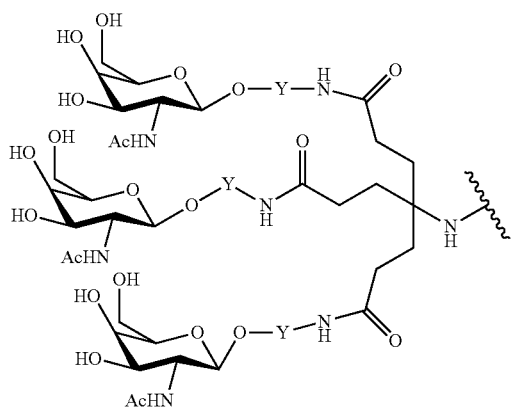

wherein Y is selected from a $C_1$-$C_{12}$ substituted or unsubstituted alkyl group.

In certain such embodiments, the cell-targeting moiety of the conjugate group has the following structure:

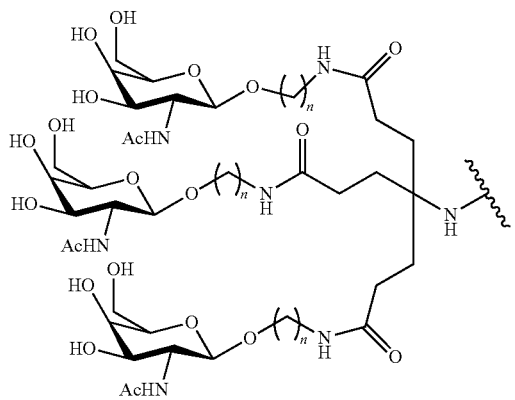

Wherein n is 1, 2, 3, 4, 5, 6, 7, 8, 9, 10, 11, or 12.

In certain such embodiments, the cell-targeting moiety of the conjugate group has the following structure:

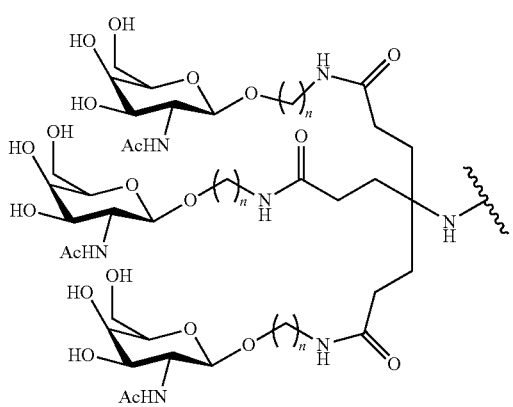

wherein n is 4, 5, 6, 7, or 8.

In certain embodiments, conjugates do not comprise a pyrrolidine.

a Certain Conjugated Antisense Compounds

In certain embodiments, the conjugates are bound to a nucleoside of the antisense oligonucleotide at the 2', 3', of 5' position of the nucleoside. In certain embodiments, a conjugated antisense compound has the following structure:

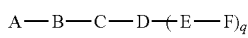

wherein
A is the antisense oligonucleotide;
B is the cleavable moiety
C is the conjugate linker
D is the branching group
each E is a tether;
each F is a ligand; and
q is an integer between 1 and 5.

In certain embodiments, a conjugated antisense compound has the following structure:

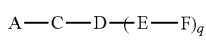

wherein
A is the antisense oligonucleotide;
C is the conjugate linker
D is the branching group
each E is a tether;
each F is a ligand; and
q is an integer between 1 and 5.

In certain such embodiments, the conjugate linker comprises at least one cleavable bond.

In certain such embodiments, the branching group comprises at least one cleavable bond.

In certain embodiments each tether comprises at least one cleavable bond.

In certain embodiments, the conjugates are bound to a nucleoside of the antisense oligonucleotide at the 2', 3', of 5' position of the nucleoside.

In certain embodiments, a conjugated antisense compound has the following structure:

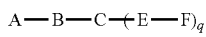

wherein
A is the antisense oligonucleotide;
B is the cleavable moiety
C is the conjugate linker
each E is a tether;
each F is a ligand; and
q is an integer between 1 and 5.

In certain embodiments, the conjugates are bound to a nucleoside of the antisense oligonucleotide at the 2', 3', of 5' position of the nucleoside. In certain embodiments, a conjugated antisense compound has the following structure:

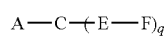

wherein
A is the antisense oligonucleotide;
C is the conjugate linker
each E is a tether;
each F is a ligand; and
q is an integer between 1 and 5.

In certain embodiments, a conjugated antisense compound has the following structure:

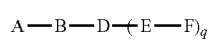

wherein
A is the antisense oligonucleotide;
B is the cleavable moiety
D is the branching group
each E is a tether;
each F is a ligand; and
q is an integer between 1 and 5.

In certain embodiments, a conjugated antisense compound has the following structure:

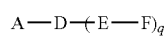

wherein
A is the antisense oligonucleotide;
D is the branching group
each E is a tether;
each F is a ligand; and
q is an integer between 1 and 5.

In certain such embodiments, the conjugate linker comprises at least one cleavable bond.

In certain embodiments each tether comprises at least one cleavable bond.

In certain embodiments, a conjugated antisense compound has a structure selected from among the following:

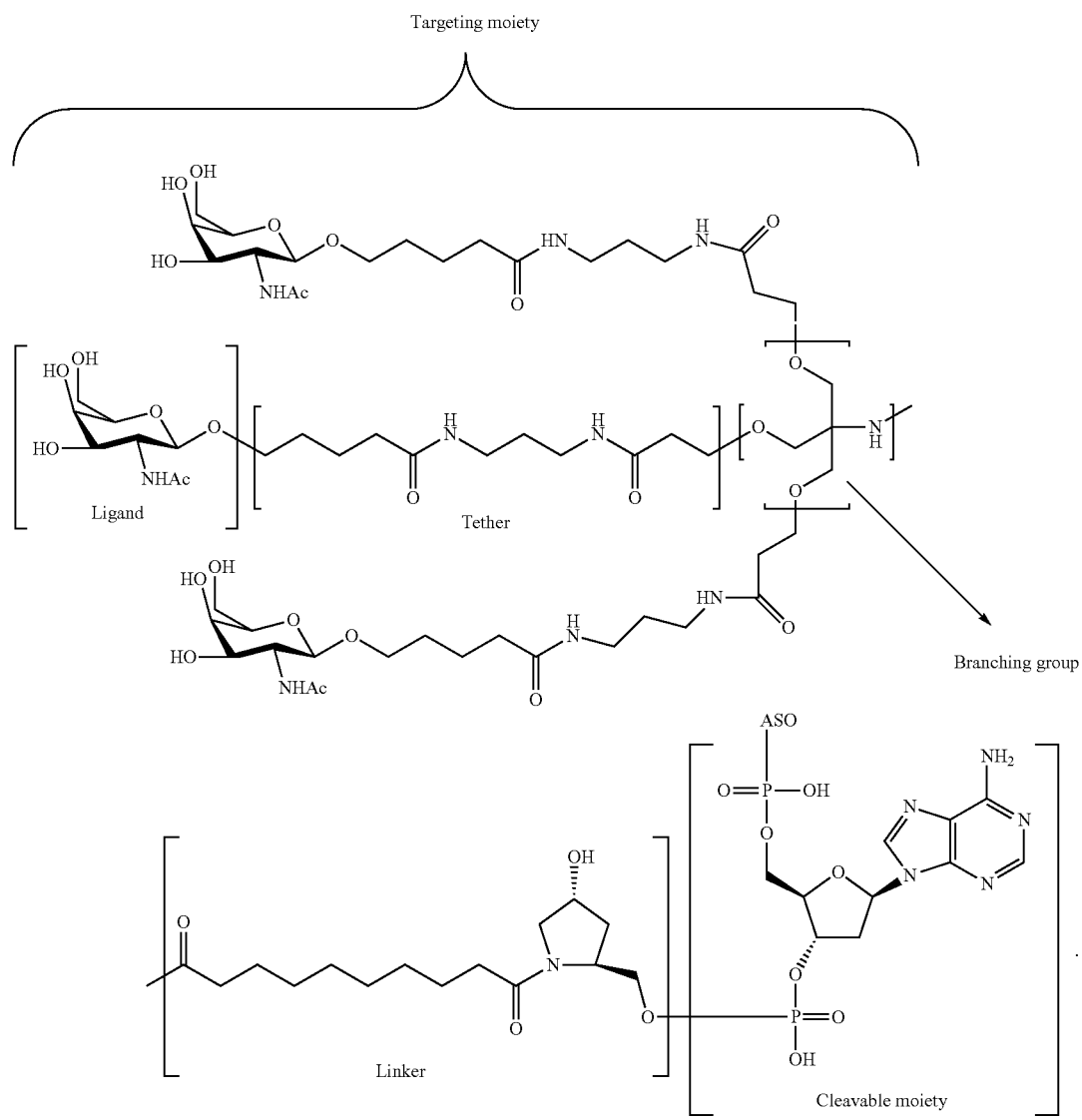
In certain embodiments, a conjugated antisense compound has a structure selected from among the following:
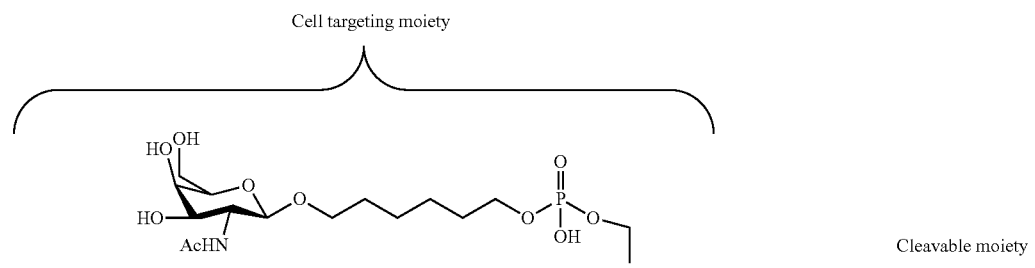

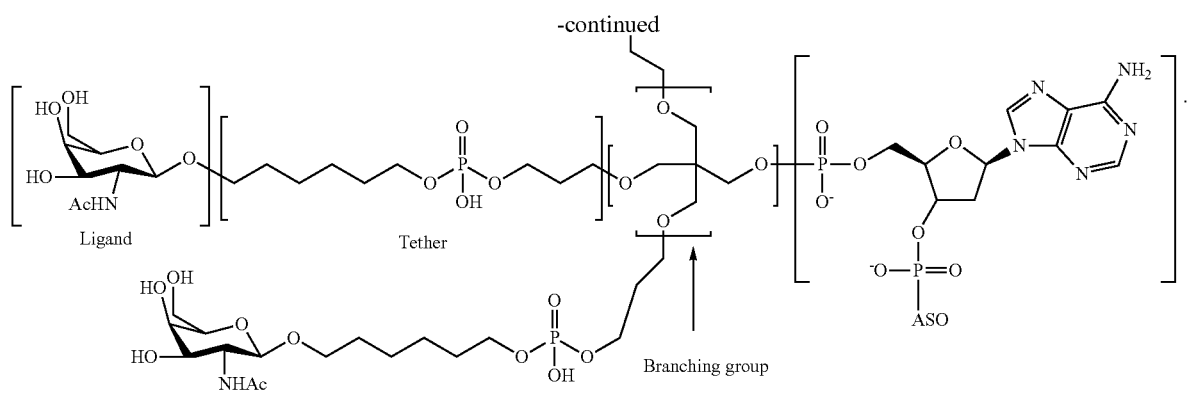

In certain embodiments, a conjugated antisense compound has a structure selected from among the following:

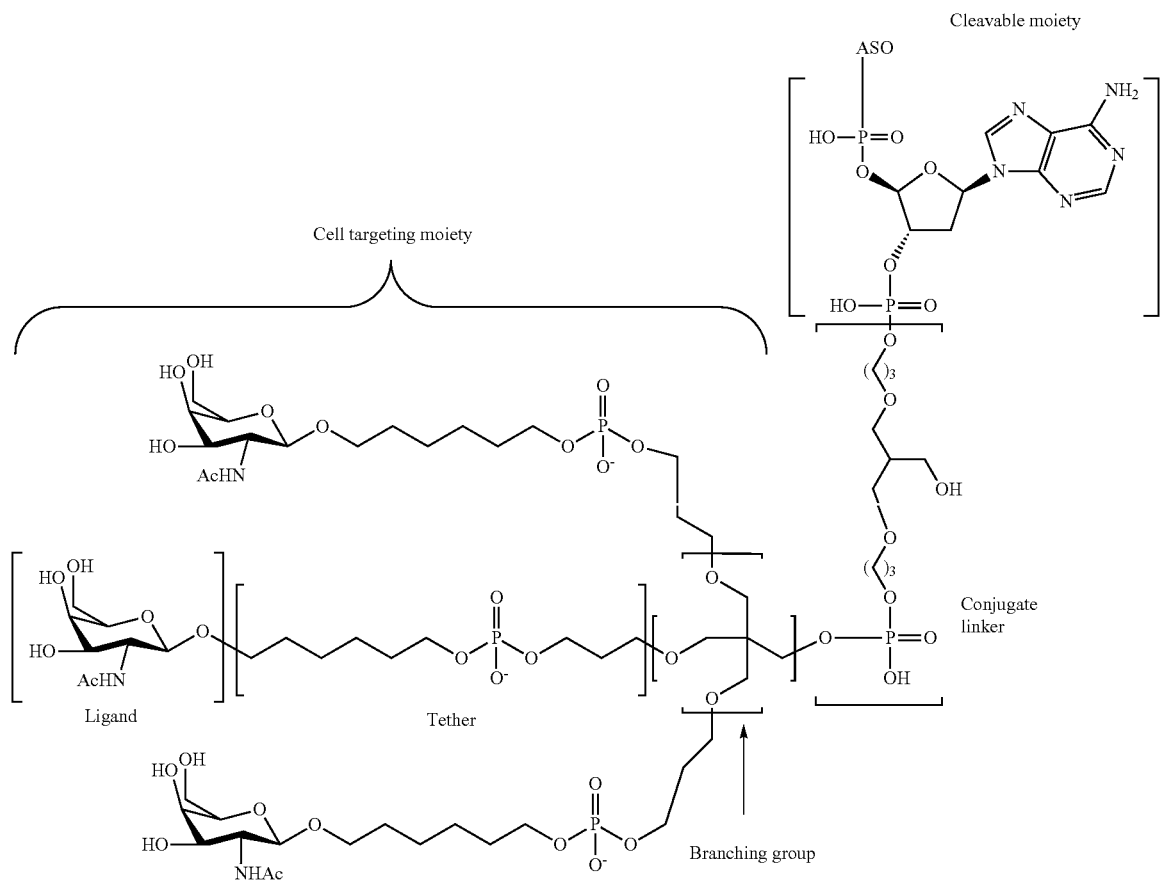

In certain embodiments, a compound comprises an ISIS oligonucleotide targeting GHR conjugated to GalNAc on the 5' end. For instance, in certain embodiments, a compound comprises ISIS 532401 conjugated to GalNAc on the 5' end. In further embodiments, the compound has the following chemical structure comprising or consisting of ISIS 532401 (SEQ ID NO: 703) with 5'-X, wherein X is a conjugate group comprising GalNAc as described herein:

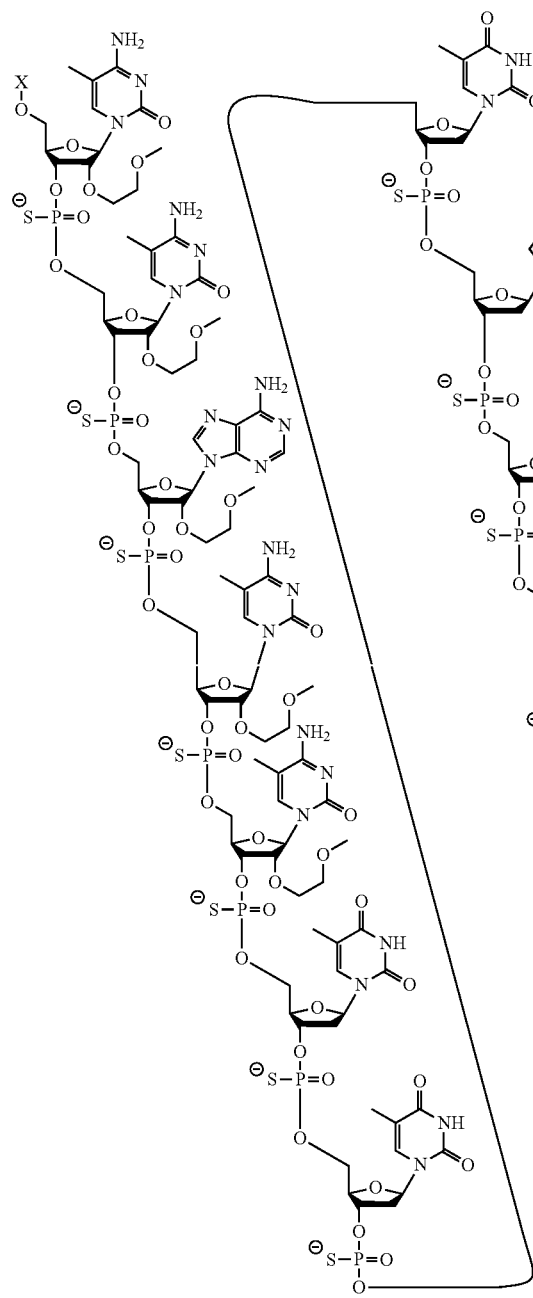
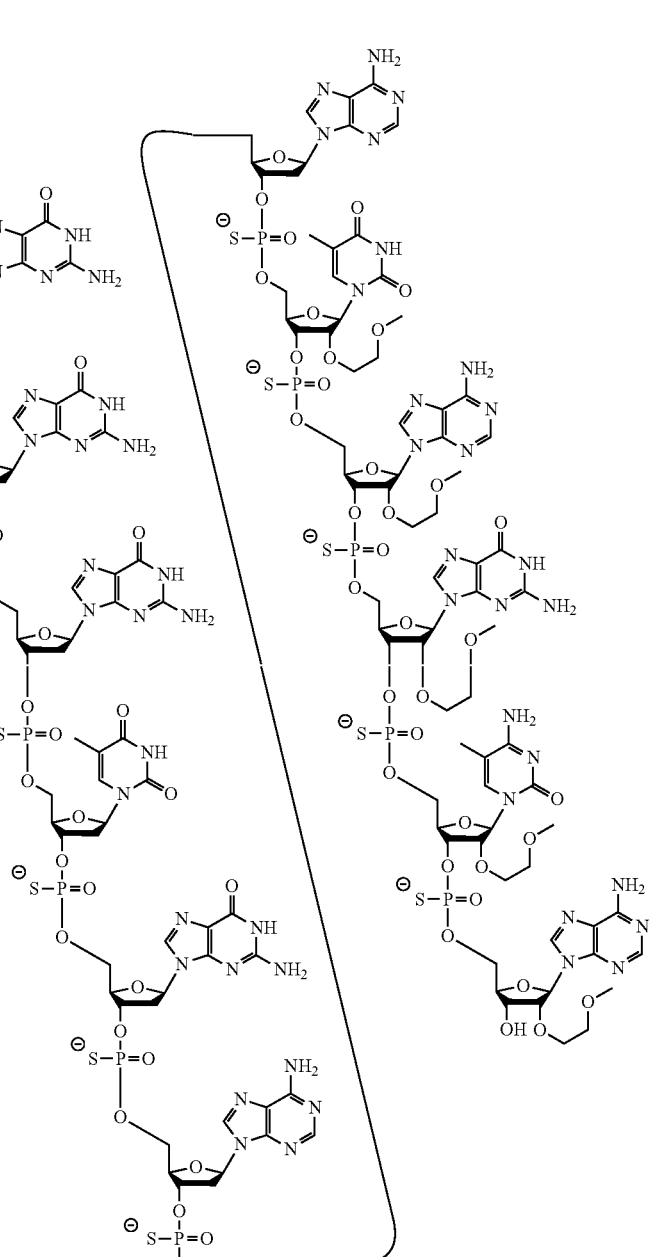

wherein X is a conjugate group comprising GalNAc.

In certain embodiments, a compound comprises an ISIS oligonucleotide targeting GHR conjugated to GalNAc, and wherein each internucleoside linkage of the oligonucleotide is a phosphorothioate linkage. In further embodiments, the compound comprises the sequence of ISIS 532401 (SEQ ID NO: 703) conjugated to GalNAc, and wherein each internucleoside linkage of the oligonucleotide is a phosphorothioate linkage. In such embodiments, the chemical structure is as follows:

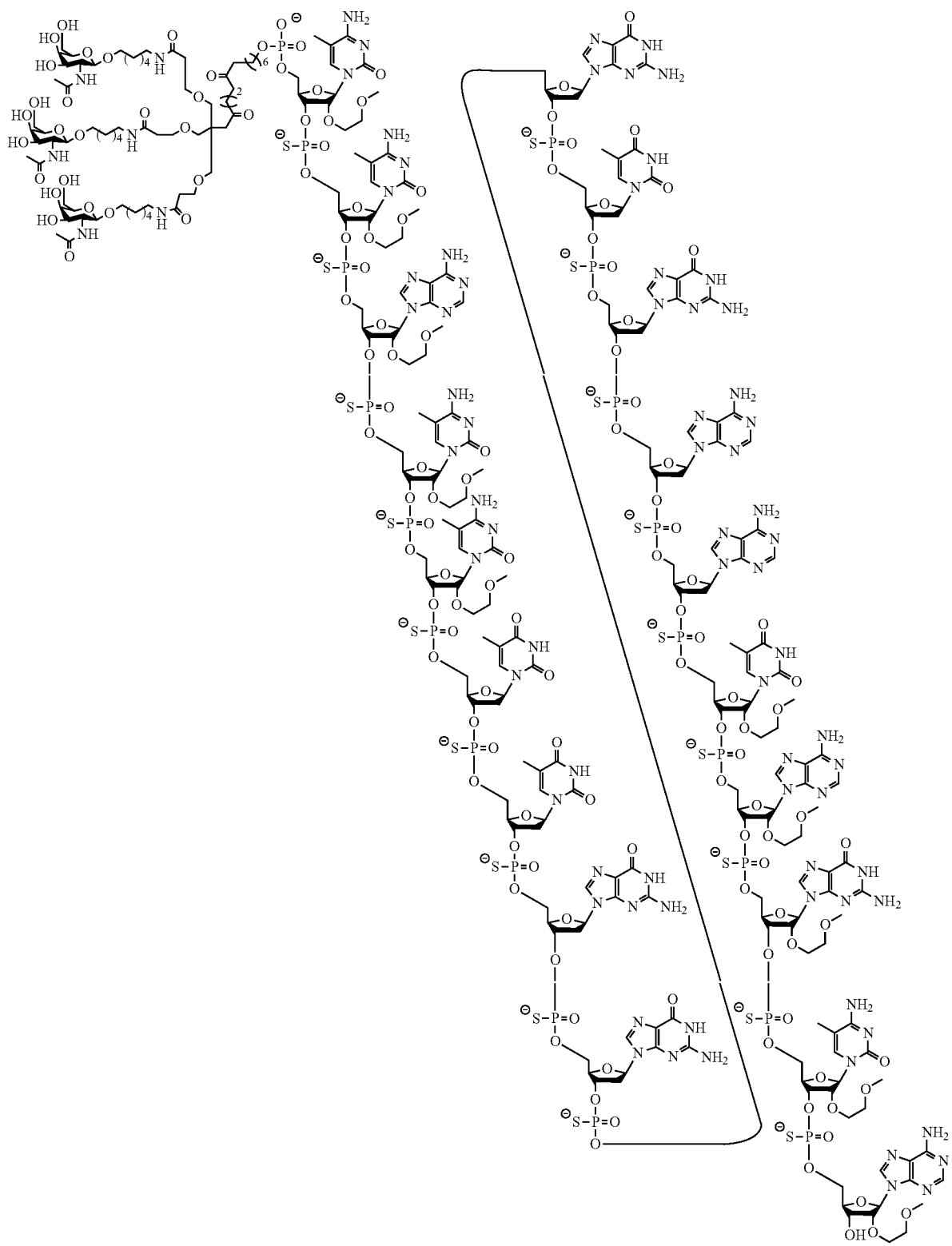

In certain embodiments, a compound comprises an ISIS oligonucleotide targeting GHR conjugated to GalNAc, and wherein each internucleoside linkage of the oligonucleotide is a phosphorothioate linkage or a phosphodiester linkage. In further embodiments, the compound comprises the sequence of ISIS 532401 (SEQ ID NO: 703) conjugated to GalNAc, and wherein each internucleoside linkage of the oligonucleotide is a phosphorothioate linkage or a phosphodiester linkage. In such embodiments, the chemical structure is as follows:

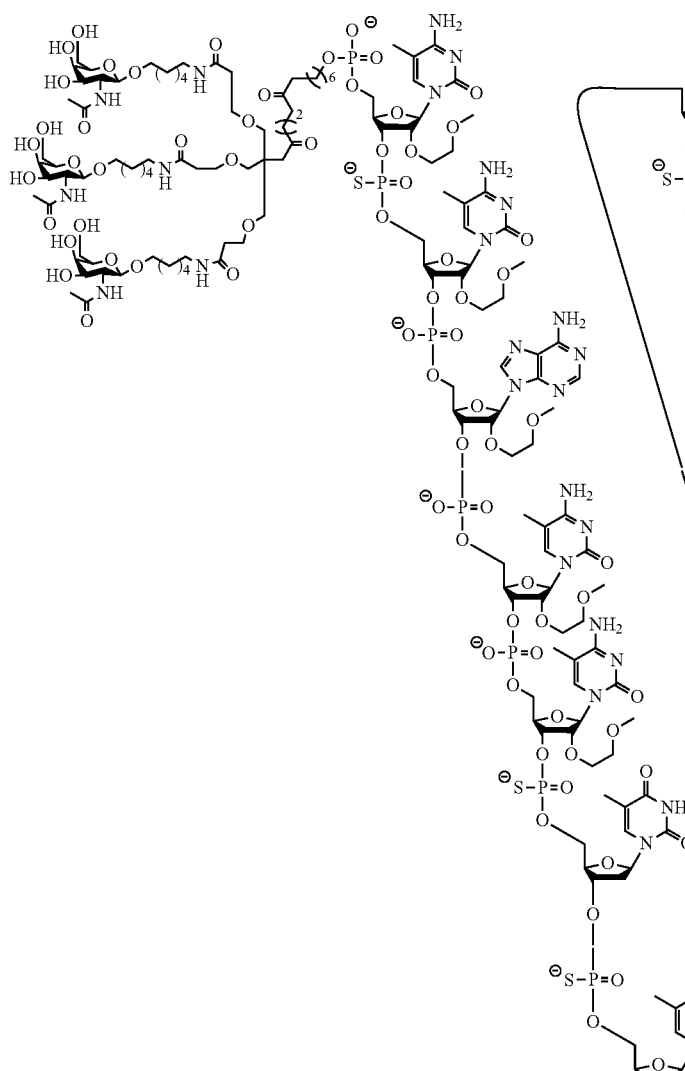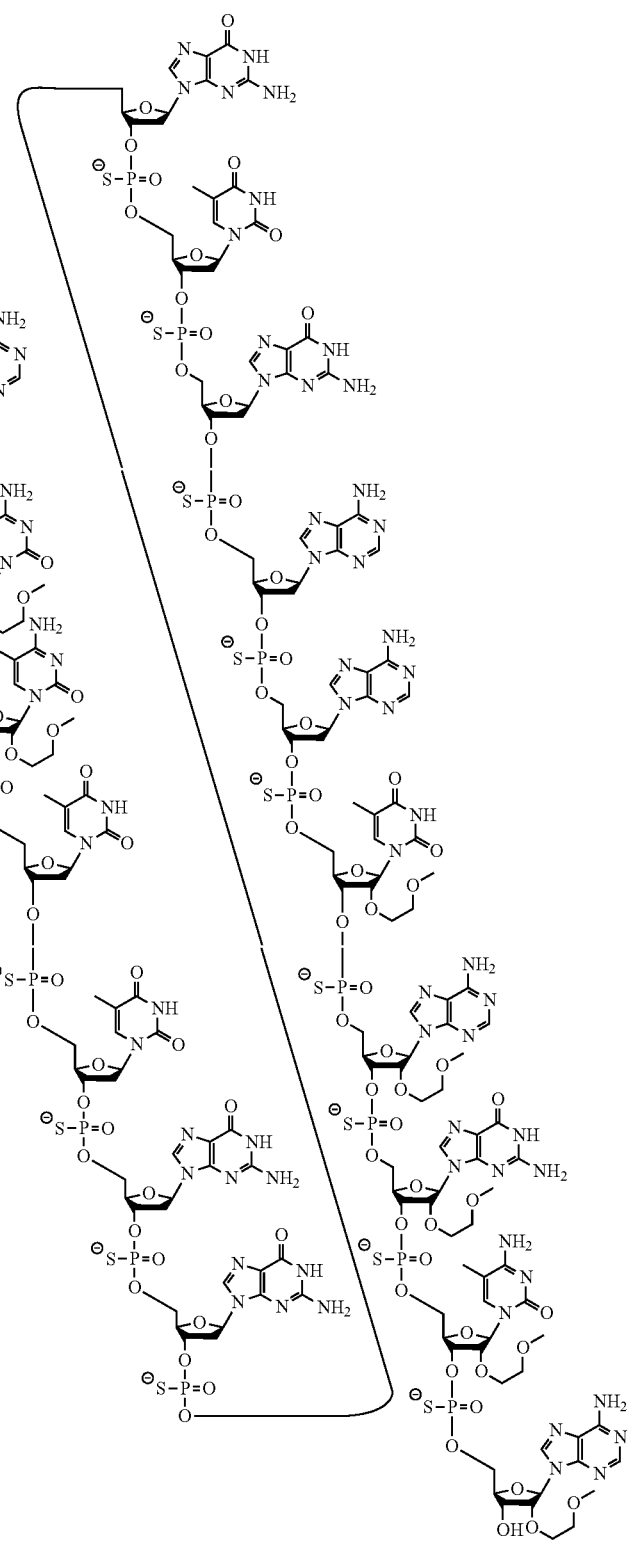
In certain embodiments, a compound comprises an ISIS oligonucleotide targeting GHR conjugated to GalNAc. In further such embodiments, the compound comprises the sequence of ISIS 532401 (SEQ ID NO: 703) conjugated to GalNAc, and is represented by the following chemical structure:

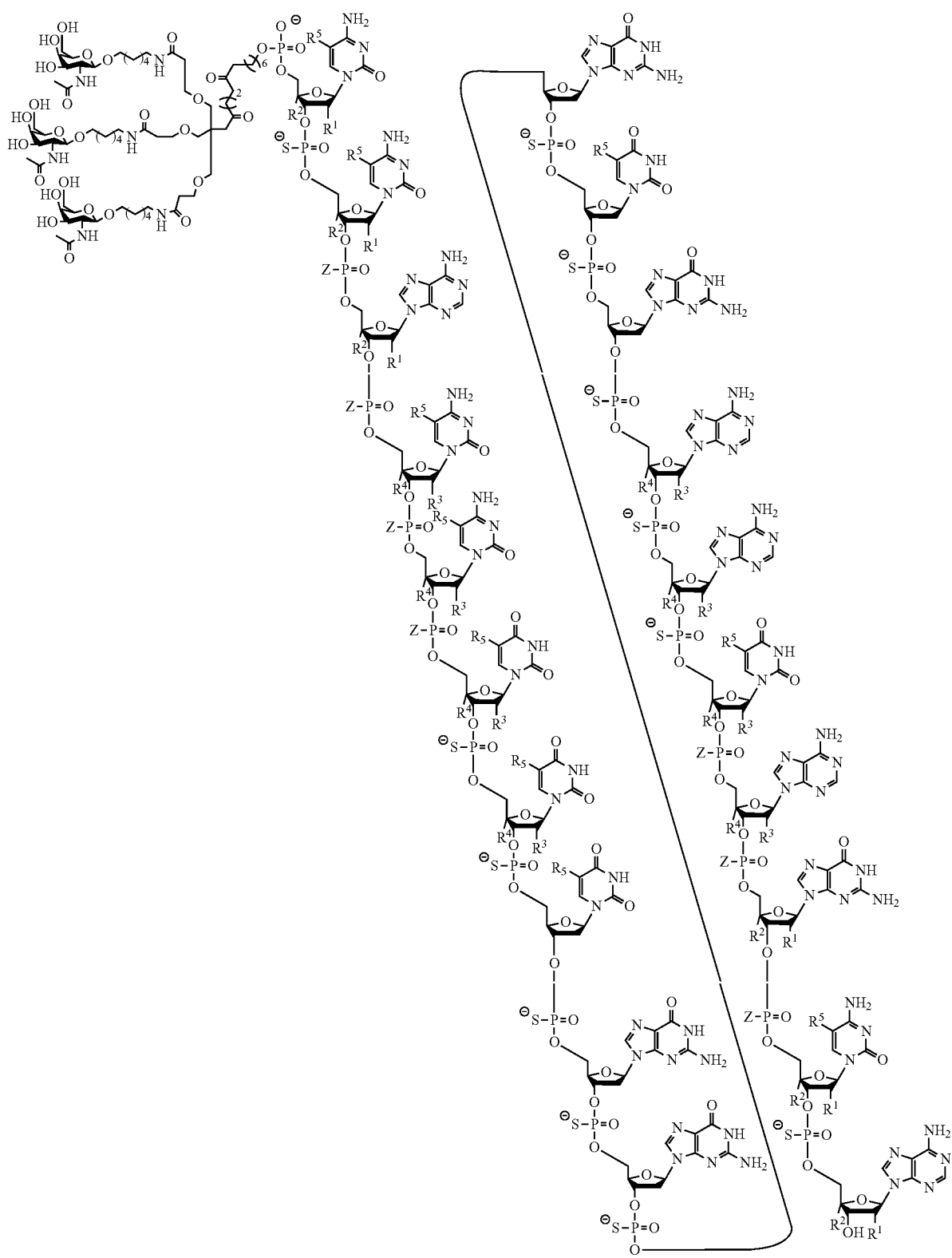
Wherein either R[1] is —OCH$_2$CH$_2$OCH$_3$ (MOE) and R[2] is H; or R[1] and R[2] together form a bridge, wherein R[1] is —O— and R[2] is —CH$_2$—, —CH(CH$_3$)—, or —CH$_2$CH$_2$—, and R[1] and R[2] are directly connected such that the resulting bridge is selected from: —O—CH$_2$—, —O—CH(CH$_3$)—, and —O—CH$_2$CH$_2$—;

And for each pair of $R^3$ and $R^4$ on the same ring, independently for each ring: either $R^3$ is selected from H and —OCH$_2$CH$_2$OCH$_3$ and $R^4$ is H; or $R^3$ and $R^4$ together form a bridge, wherein $R^3$ is —O—, and $R^4$ is —CH$_2$—, —CH(CH$_3$)—, or —CH$_2$CH$_2$— and $R^3$ and $R^4$ are directly connected such that the resulting bridge is selected from: —O—CH$_2$—, —O—CH(CH$_3$)—, and —O—CH$_2$CH$_2$—;

And $R^5$ is selected from H and —CH$_3$;

And Z is selected from S$^-$ and O$^-$.

Representative United States patents, United States patent application publications, and international patent application publications that teach the preparation of certain of the above noted conjugates, conjugated antisense compounds, tethers, linkers, branching groups, ligands, cleavable moieties as well as other modifications include without limitation, U.S. Pat. Nos. 5,994,517, 6,300,319, 6,660,720, 6,906,182, 7,262,177, 7,491,805, 8,106,022, 7,723,509, US 2006/0148740, US 2011/0123520, WO 2013/033230 and WO 2012/037254, each of which is incorporated by reference herein in its entirety.

Representative publications that teach the preparation of certain of the above noted conjugates, conjugated antisense compounds, tethers, linkers, branching groups, ligands, cleavable moieties as well as other modifications include without limitation, BIESSEN et al., "The Cholesterol Derivative of a Triantennary Galactoside with High Affinity for the Hepatic Asialoglycoprotein Receptor: a Potent Cholesterol Lowering Agent" J. Med. Chem. (1995) 38:1846-1852, BIESSEN et al., "Synthesis of Cluster Galactosides with High Affinity for the Hepatic Asialoglycoprotein Receptor" J. Med. Chem. (1995) 38:1538-1546, LEE et al., "New and more efficient multivalent glyco-ligands for asialoglycoprotein receptor of mammalian hepatocytes" Bioorganic & Medicinal Chemistry (2011) 19:2494-2500, RENSEN et al., "Determination of the Upper Size Limit for Uptake and Processing of Ligands by the Asialoglycoprotein Receptor on Hepatocytes in Vitro and in Vivo" J. Biol. Chem. (2001) 276(40):37577-37584, RENSEN et al., "Design and Synthesis of Novel N-Acetylgalactosamine-Terminated Glycolipids for Targeting of Lipoproteins to the Hepatic Asialoglycoprotein Receptor" J. Med. Chem. (2004) 47:5798-5808, SLIEDREGT et al., "Design and Synthesis of Novel Amphiphilic Dendritic Galactosides for Selective Targeting of Liposomes to the Hepatic Asialoglycoprotein Receptor" J. Med. Chem. (1999) 42:609-618, and Valentijn et al., "Solid-phase synthesis of lysine-based cluster galactosides with high affinity for the Asialoglycoprotein Receptor" Tetrahedron, 1997, 53(2), 759-770, each of which is incorporated by reference herein in its entirety.

In certain embodiments, conjugated antisense compounds comprise an RNase H based oligonucleotide (such as a gapmer) or a splice modulating oligonucleotide (such as a fully modified oligonucleotide) and any conjugate group comprising at least one, two, or three GalNAc groups. In certain embodiments a conjugated antisense compound comprises any conjugate group found in any of the following references: Lee, Carbohydr Res, 1978, 67, 509-514; Connolly et al., J Biol Chem, 1982, 257, 939-945; Pavia et al., Int J Pep Protein Res, 1983, 22, 539-548; Lee et al., Biochem, 1984, 23, 4255-4261; Lee et al., Glycoconjugate J, 1987, 4, 317-328; Toyokuni et al., Tetrahedron Lett, 1990, 31, 2673-2676; Biessen et al., J Med Chem, 1995, 38, 1538-1546; Valentijn et al., Tetrahedron, 1997, 53, 759-770; Kim et al., Tetrahedron Lett, 1997, 38, 3487-3490; Lee et al., Bioconjug Chem, 1997, 8, 762-765; Kato et al., Glycobiol, 2001, 11, 821-829; Rensen et al., J Biol Chem, 2001, 276, 37577-37584; Lee et al., Methods Enzymol, 2003, 362, 38-43; Westerlind et al., Glycoconj J, 2004, 21, 227-241; Lee et al., Bioorg Med Chem Lett, 2006, 16(19), 5132-5135; Maierhofer et al., Bioorg Med Chem, 2007, 15, 7661-7676; Khorev et al., Bioorg Med Chem, 2008, 16, 5216-5231; Lee et al., Bioorg Med Chem, 2011, 19, 2494-2500; Komilova et al., Analyt Biochem, 2012, 425, 43-46; Pujol et al., Angew Chemie Int Ed Engl, 2012, 51, 7445-7448; Biessen et al., J Med Chem, 1995, 38, 1846-1852; Sliedregt et al., J Med Chem, 1999, 42, 609-618; Rensen et al., J Med Chem, 2004, 47, 5798-5808; Rensen et al., Arterioscler Thromb Vasc Biol, 2006, 26, 169-175; van Rossenberg et al., Gene Ther, 2004, 11, 457-464; Sato et al., J Am Chem Soc, 2004, 126, 14013-14022; Lee et al., J Org Chem, 2012, 77, 7564-7571; Biessen et al., FASEB J, 2000, 14, 1784-1792; Rajur et al., Bioconjug Chem, 1997, 8, 935-940; Duff et al., Methods Enzymol, 2000, 313, 297-321; Maier et al., Bioconjug Chem, 2003, 14, 18-29; Jayaprakash et al., Org Lett, 2010, 12, 5410-5413; Manoharan, Antisense Nucleic Acid Drug Dev, 2002, 12, 103-128; Merwin et al., Bioconjug Chem, 1994, 5, 612-620; Tomiya et al., Bioorg Med Chem, 2013, 21, 5275-5281; International applications WO1998/013381; WO2011/038356; WO1997/046098; WO2008/098788; WO2004/101619; WO2012/037254; WO2011/120053; WO2011/100131; WO2011/163121; WO2012/177947; WO2013/033230; WO2013/075035; WO2012/083185; WO2012/083046; WO2009/082607; WO2009/134487; WO2010/144740; WO2010/148013; WO1997/020563; WO2010/088537; WO2002/043771; WO2010/129709; WO2012/068187; WO2009/126933; WO2004/024757; WO2010/054406; WO2012/089352; WO2012/089602; WO2013/166121; WO2013/165816; U.S. Pat. Nos. 4,751,219; 8,552,163; 6,908,903; 7,262,177; 5,994,517; 6,300,319; 8,106,022; 7,491,805; 7,491,805; 7,582,744; 8,137,695; 6,383,812; 6,525,031; 6,660,720; 7,723,509; 8,541,548; 8,344,125; 8,313,772; 8,349,308; 8,450,467; 8,501,930; 8,158,601; 7,262,177; 6,906,182; 6,620,916; 8,435,491; 8,404,862; 7,851,615; Published U.S. Patent Application Publications US2011/0097264; US2011/0097265; US2013/0004427; US2005/0164235; US2006/0148740; US2008/0281044; US2010/0240730; US2003/0119724; US2006/0183886; US2008/0206869; US2011/0269814; US2009/0286973; US2011/0207799; US2012/0136042; US2012/0165393; US2008/0281041; US2009/0203135; US2012/0035115; US2012/0095075; US2012/0101148; US2012/0128760; US2012/0157509; US2012/0230938; US2013/0109817; US2013/0121954; US2013/0178512; US2013/0236968; US2011/0123520; US2003/0077829; US2008/0108801; and US2009/0203132; each of which is incorporated by reference in its entirety.

In Vitro Testing of Antisense Oligonucleotides

Described herein are methods for treatment of cells with antisense oligonucleotides, which can be modified appropriately for treatment with other antisense compounds.

Cells may be treated with antisense oligonucleotides when the cells reach approximately 60-80% confluency in culture.

One reagent commonly used to introduce antisense oligonucleotides into cultured cells includes the cationic lipid transfection reagent LIPOFECTIN (Invitrogen, Carlsbad, Calif.). Antisense oligonucleotides may be mixed with LIPOFECTIN in OPTI-MEM 1 (Invitrogen, Carlsbad, Calif.) to achieve the desired final concentration of antisense oligonucleotide and a LIPOFECTIN concentration that may range from 2 to 12 ug/mL per 100 nM antisense oligonucleotide.

Another reagent used to introduce antisense oligonucleotides into cultured cells includes LIPOFECTAMINE (Invitrogen, Carlsbad, Calif.). Antisense oligonucleotide is mixed with LIPOFECTAMINE in OPTI-MEM 1 reduced serum medium (Invitrogen, Carlsbad, Calif.) to achieve the desired concentration of antisense oligonucleotide and a LIPO-FECTAMINE concentration that may range from 2 to 12 ug/mL per 100 nM antisense oligonucleotide.

Another technique used to introduce antisense oligonucleotides into cultured cells includes electroporation.

Yet another technique used to introduce antisense oligonucleotides into cultured cells includes free uptake of the oligonucleotides by the cells.

Cells are treated with antisense oligonucleotides by routine methods. Cells may be harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPO-FECTAMINE. Antisense oligonucleotides are used at higher concentrations ranging from 625 to 20,000 nM when transfected using electroporation.

RNA Isolation

RNA analysis can be performed on total cellular RNA or poly(A)+ mRNA. Methods of RNA isolation are well known in the art. RNA is prepared using methods well known in the art, for example, using the TRIZOL Reagent (Invitrogen, Carlsbad, Calif.) according to the manufacturer's recommended protocols.

Certain Indications

Certain embodiments provided herein relate to methods of treating, preventing, or ameliorating a disease associated with excess growth hormone in a subject by administering a GHR specific inhibitor, such as an antisense compound or oligonucleotide targeted to GHR. In certain aspects, the disease associated with excess growth hormone is acromegaly. In certain aspects, the disease associated with excess growth hormone is gigantism.

Certain embodiments provide a method of treating, preventing, or ameliorating acromegaly in a subject by administering a GHR specific inhibitor, such as an antisense compound or oligonucleotide targeted to GHR. Acromegaly is a disease associated with excess growth hormone (GH). In over 90 percent of acromegaly patients, the overproduction of growth hormones is caused by a benign tumor of the pituitary gland, called an adenoma, which produces excess growth hormone and compresses surrounding brain tissues. Expansion of the adenoma can cause headaches and visual impairment that often accompany acromegaly. In some instances, acromegaly is caused by tumors of the pancreas, lungs, or adrenal glands that lead to an excess of GH, either by producing GH or by producing Growth Hormone Releasing Hormone (GHRH), the hormone that stimulates the pituitary to make GH.

Acromegaly most commonly affects adults in middle age and can result in severe disfigurement, complicating conditions, and premature death. Because of its pathogenesis and slow progression, acromegaly often goes undiagnosed until changes in external features become noticeable, such as changes in the face. Acromegaly is often associated with gigantism.

Features of acromegaly include soft tissue swelling resulting in enlargement of the hands, feet, nose, lips and ears, and a general thickening of the skin; soft tissue swelling of internal organs, such as the heart and kidney; vocal cord swelling resulting in a low voice and slow speech; expansion of the skull; pronounced eyebrow protrusion, often with ocular distension; pronounced lower jaw protrusion and enlargement of the tongue; teeth gapping; and carpal tunnel syndrome. In certain embodiments, any one or combination of these features of acromegaly can be treated, prevented, or ameliorated by administering a compound or composition targeted to GHR provided herein.

EXAMPLES

Non-Limiting Disclosure and Incorporation by Reference

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

It is understood that the sequence set forth in each SEQ ID NO in the examples contained herein is independent of any modification to a sugar moiety, an internucleoside linkage, or a nucleobase. As such, antisense compounds defined by a SEQ ID NO may comprise, independently, one or more modifications to a sugar moiety, an internucleoside linkage, or a nucleobase. Antisense compounds described by Isis Number (Isis No) indicate a combination of nucleobase sequence and motif.

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1

General Method for the Preparation of Phosphoramidites, Compounds 1, 1a and 2

Compounds 1, 1a and 2 were prepared as per the procedures well known in the art as described in the specification herein (see Seth et al., Bioorg. Med. Chem., 2011, 21(4), 1122-1125, J. Org. Chem., 2010, 75(5), 1569-1581, Nucleic Acids Symposium Series, 2008, 52(1), 553-554); and also see published PCT International Applications (WO 2011/115818, WO 2010/077578, WO2010/036698, WO2009/143369, WO 2009/006478, and WO 2007/090071), and U.S. Pat. No. 7,569,686).

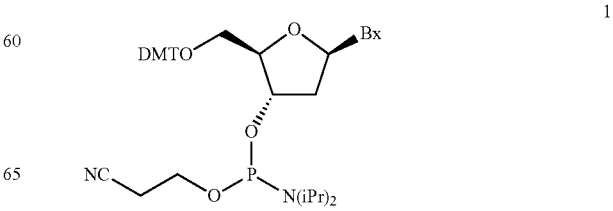

1

-continued

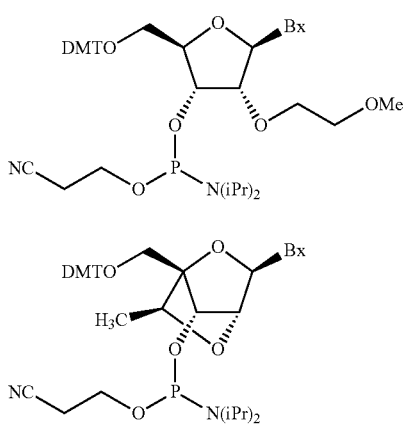

Bx is a heterocyclic base;

Example 2

Preparation of Compound 7

Compounds 3 (2-acetamido-1,3,4,6-tetra-O-acetyl-2-deoxy-β-D-galactopyranose or galactosamine pentaacetate) is commercially available. Compound 5 was prepared according to published procedures (Weber et al., *J. Med. Chem.*, 1991, 34, 2692).

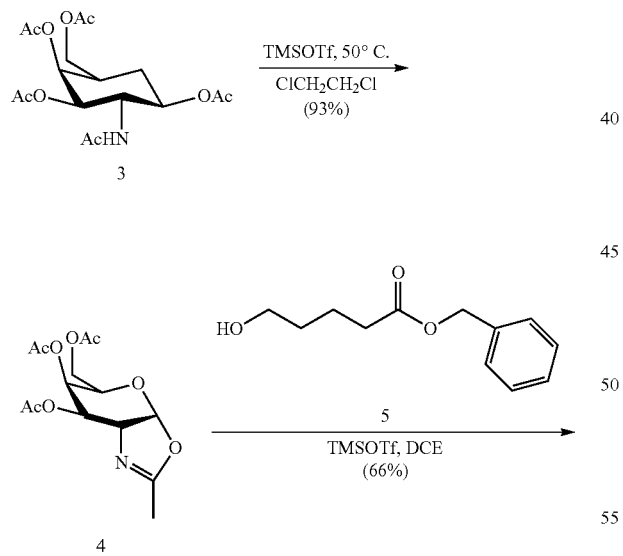

-continued

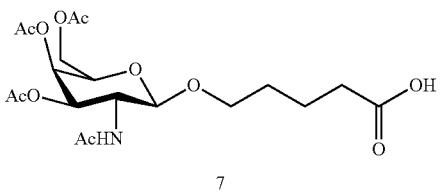

Example 3

Preparation of Compound 11

Compounds 8 and 9 are commercially available.

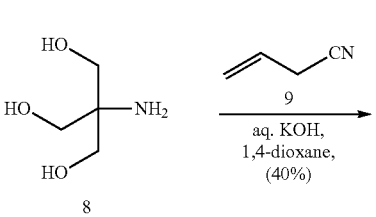

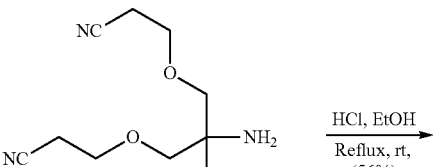

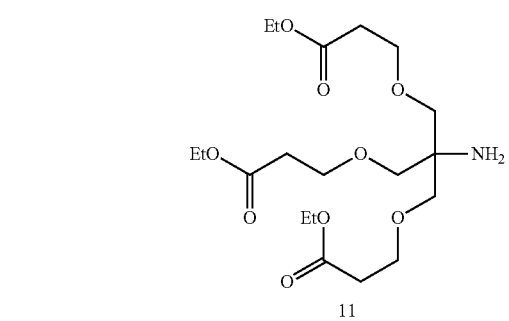

Example 4

Preparation of Compound 18

Compound 11 was prepared as per the procedures illustrated in Example 3. Compound 14 is commercially available. Compound 17 was prepared using similar procedures reported by Rensen et al., *J. Med. Chem.*, 2004, 47, 5798-5808.

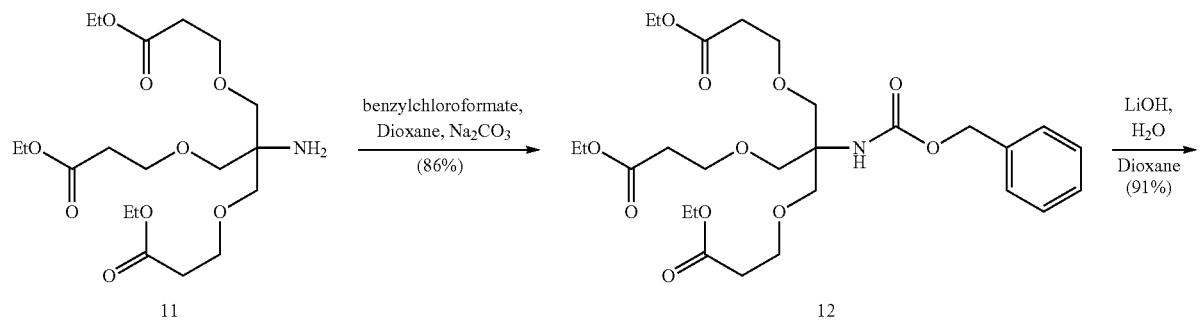
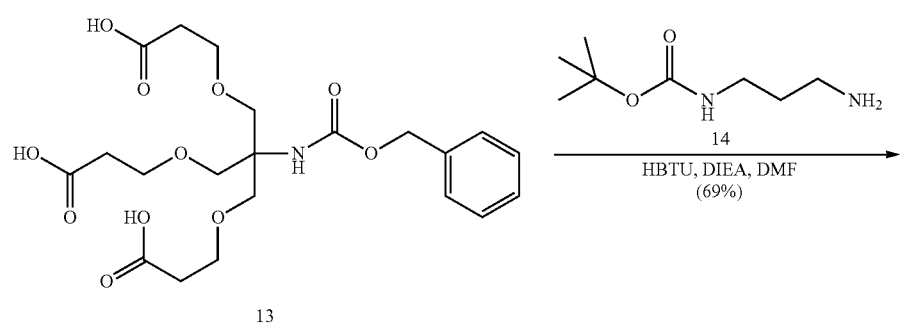
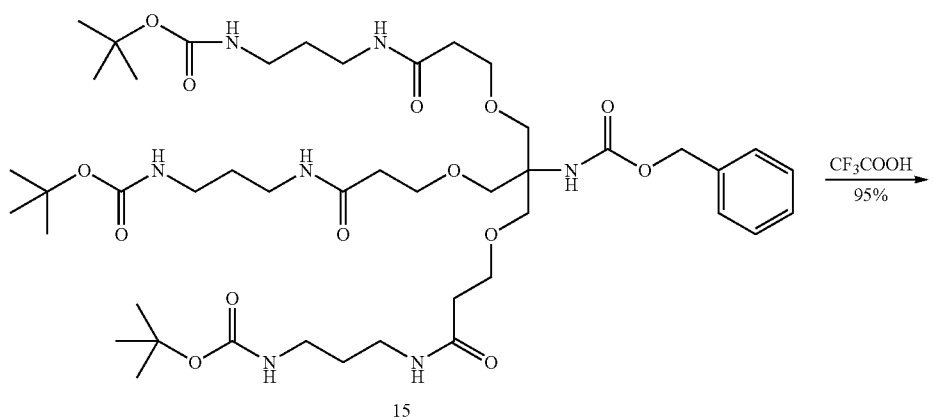
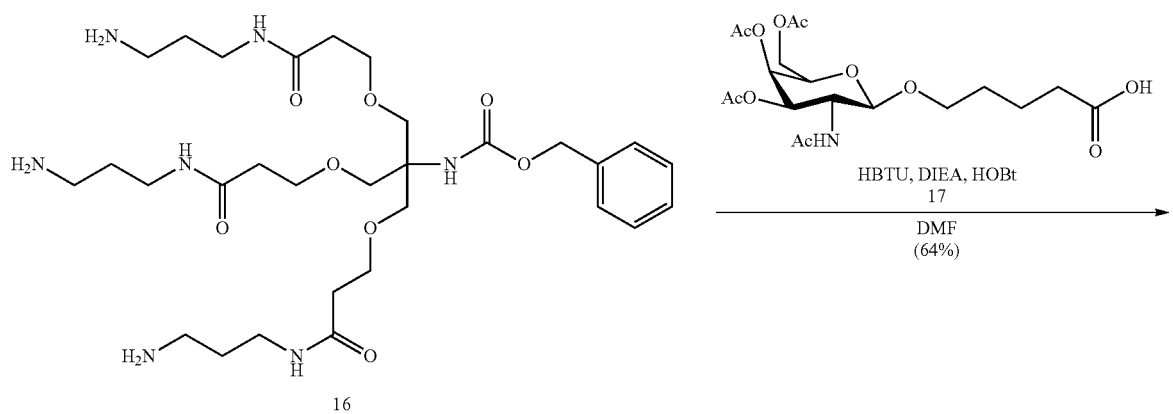

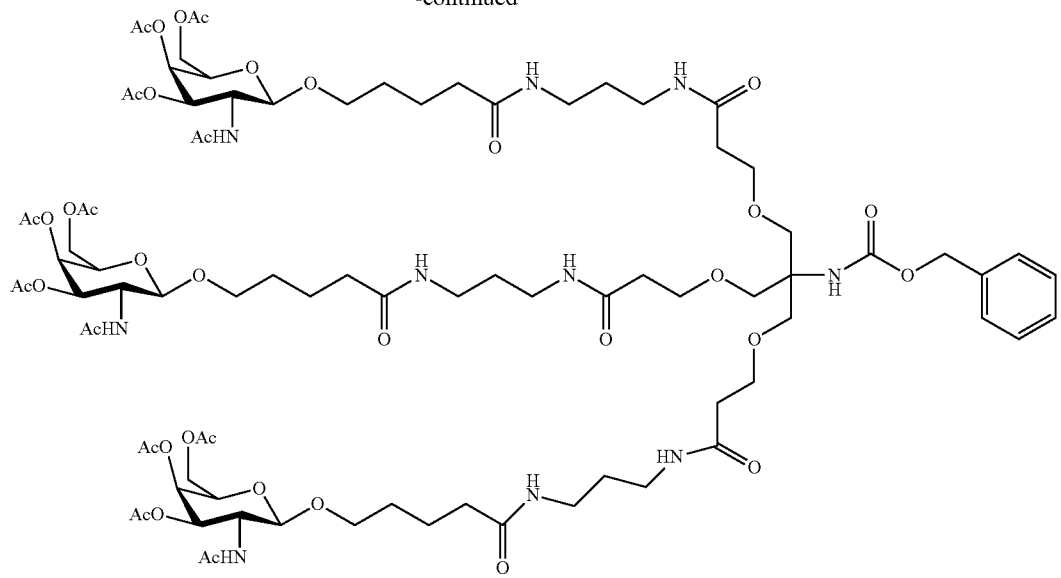
18
Example 5
Preparation of Compound 23
Compounds 19 and 21 are commercially available.
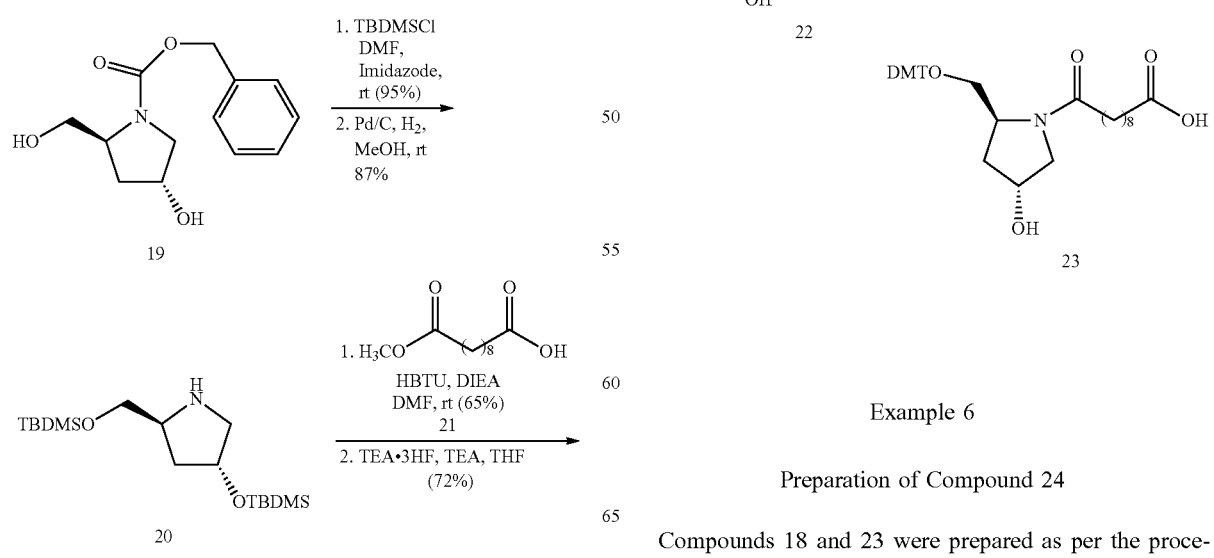
Example 6
Preparation of Compound 24
Compounds 18 and 23 were prepared as per the procedures illustrated in Examples 4 and 5.

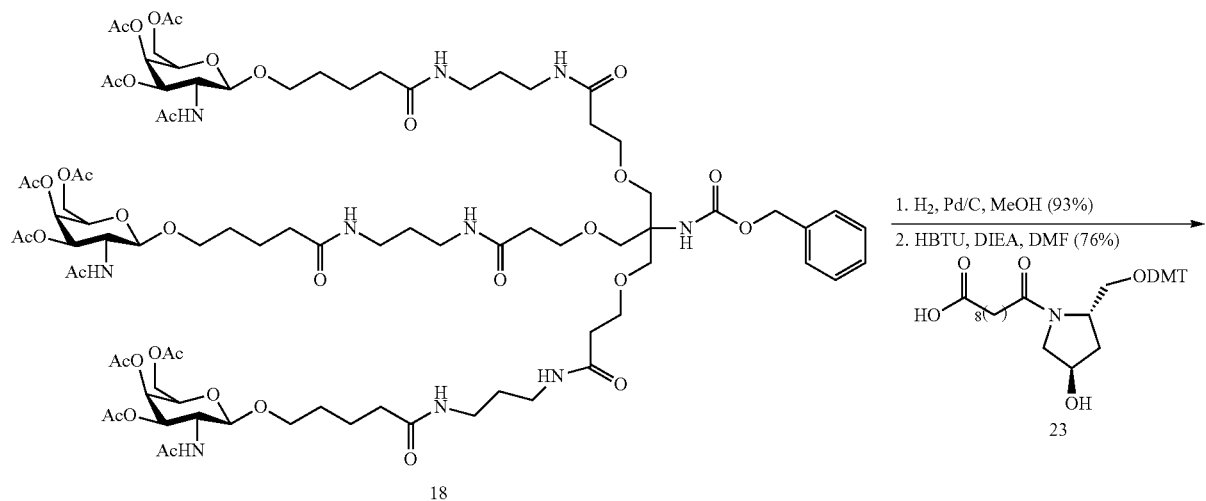
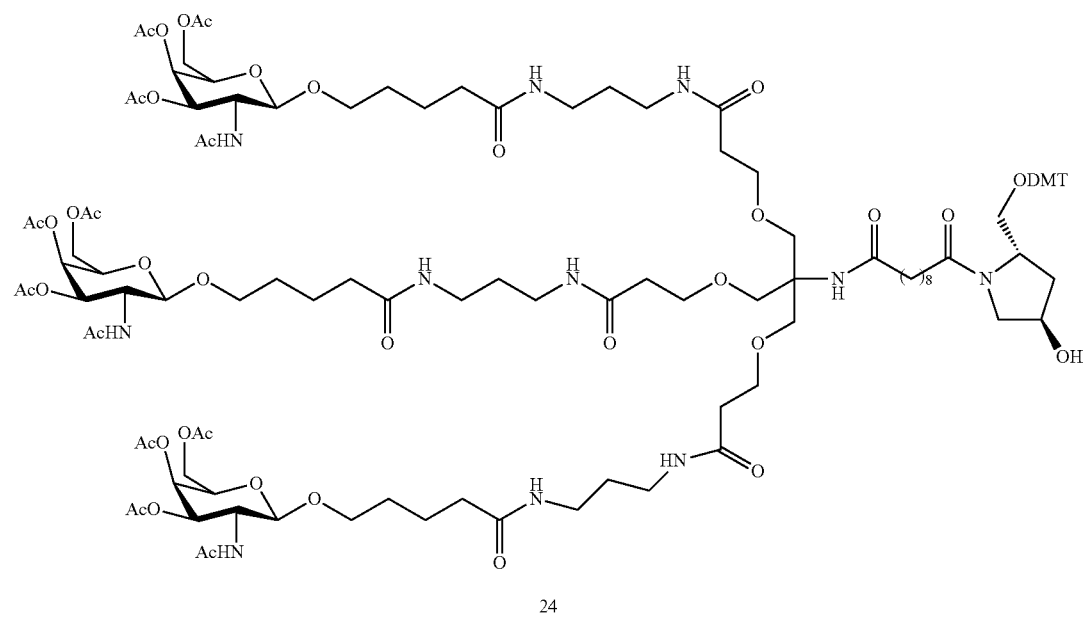
Example 7
Preparation of Compound 25
Compound 24 was prepared as per the procedures illustrated in Example 6.

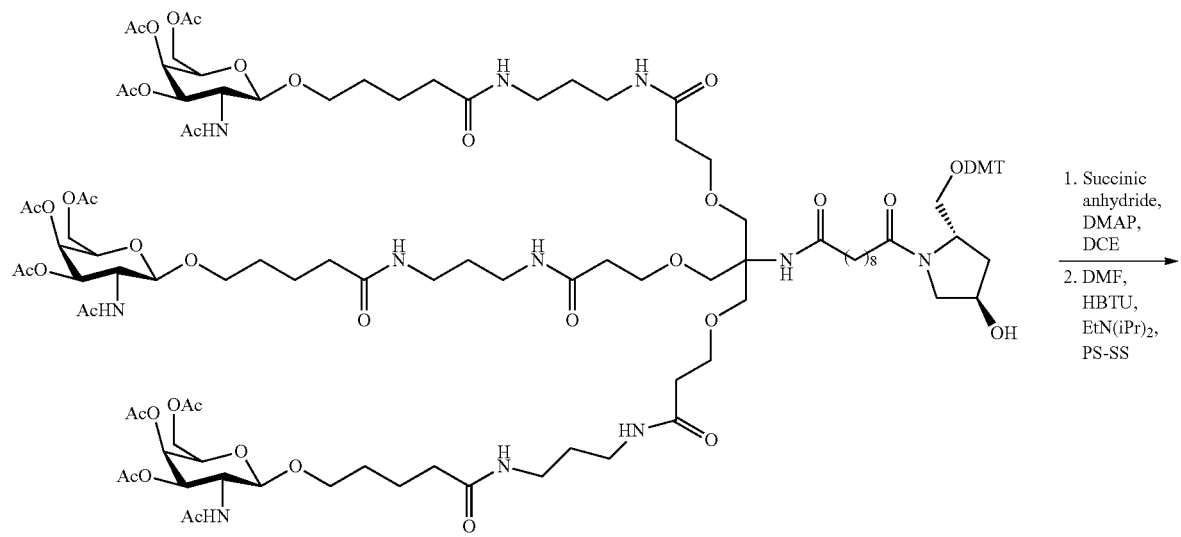
24
1. Succinic anhydride, DMAP, DCE
2. DMF, HBTU, EtN(iPr)$_2$, PS-SS
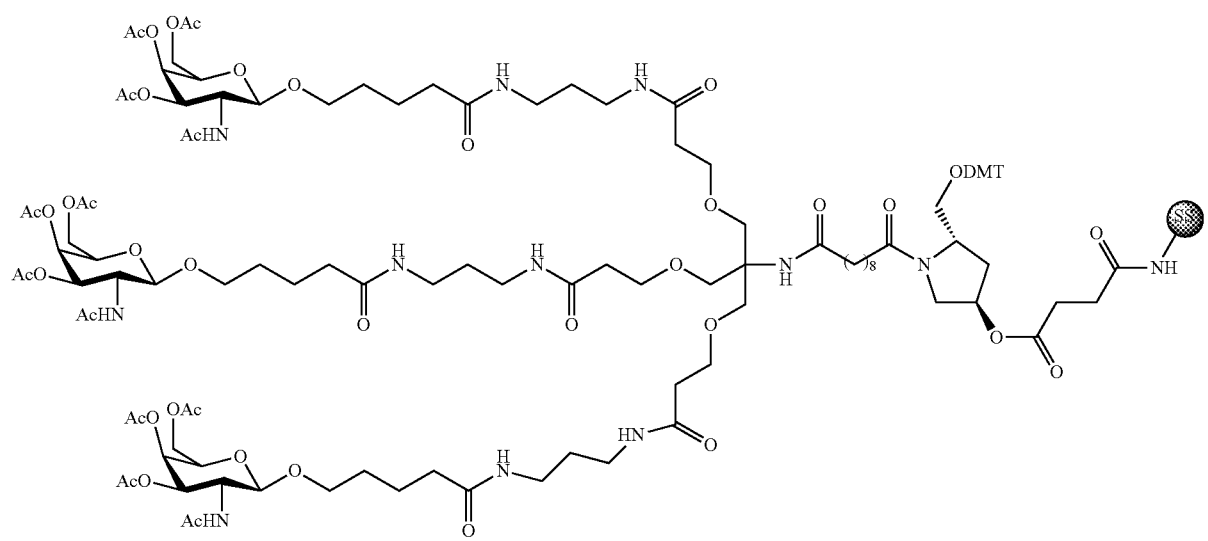
25
Example 8
Preparation of Compound 26
Compound 24 is prepared as per the procedures illustrated in Example 6.

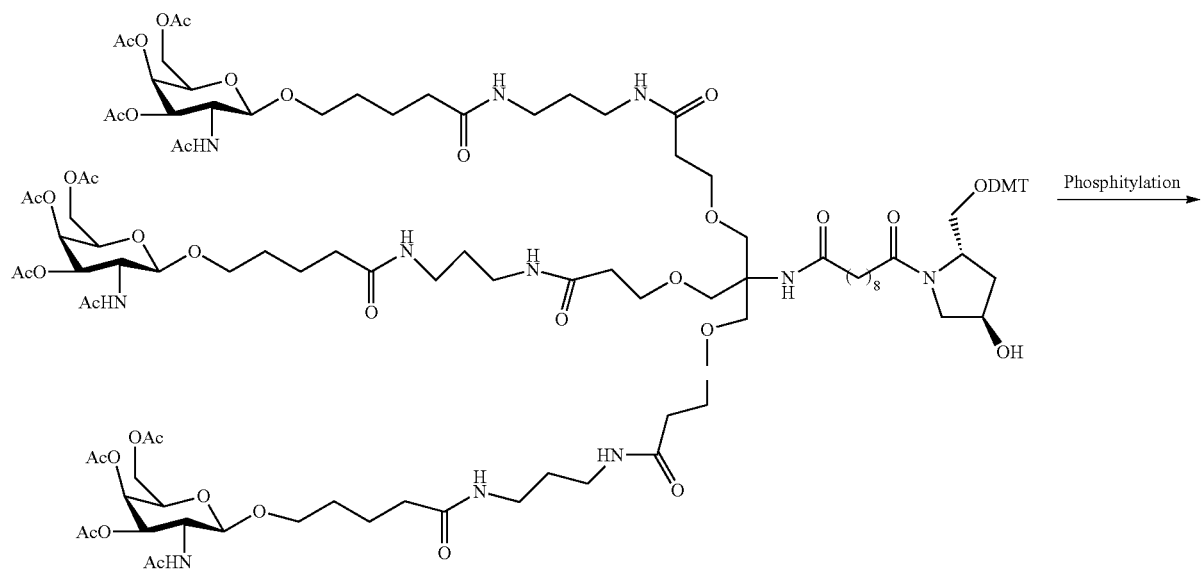
24
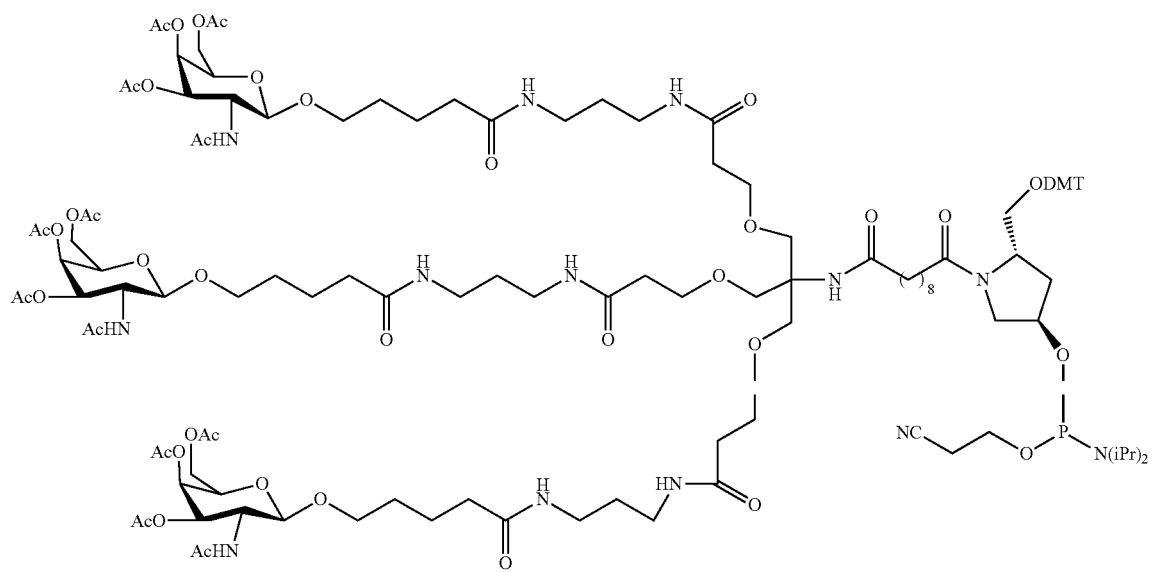
26

Example 9
General Preparation of Conjugated ASOs Comprising GalNAc₃-1 at the 3' Terminus, Compound 29
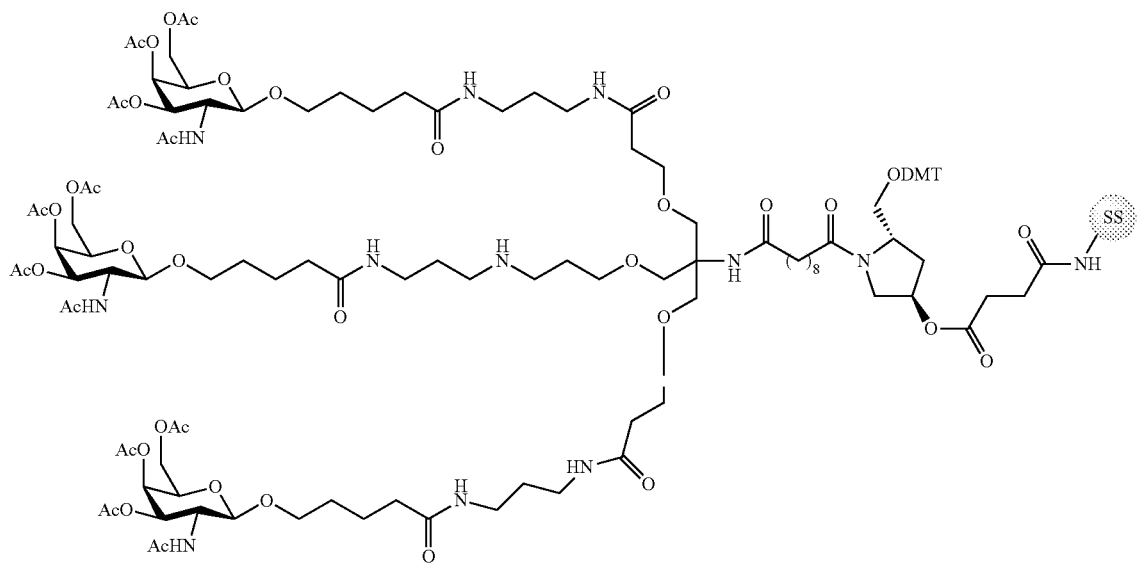
25
1. DCA, DCM
2. DCI, NMI, ACN
   Phosphoramidite
   building block 1
3. Capping
4. t-BuOOH
DNA/RNA automated synthesizer
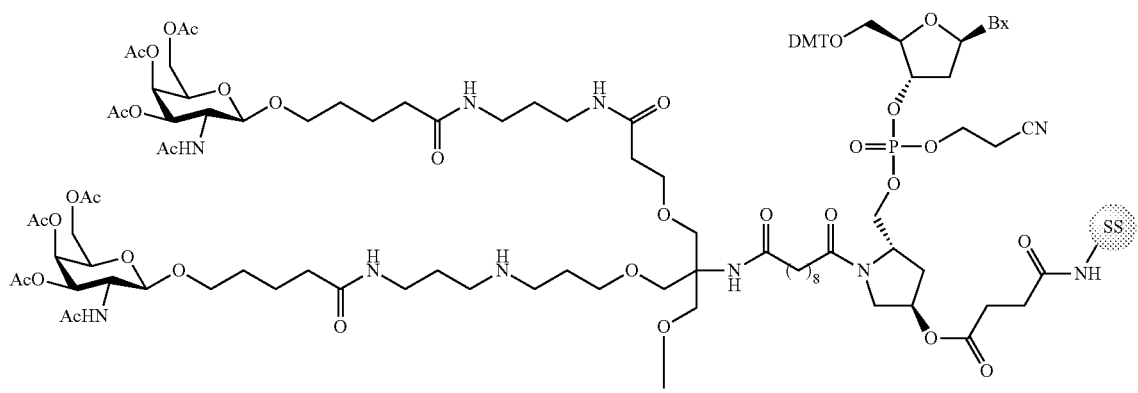

-continued
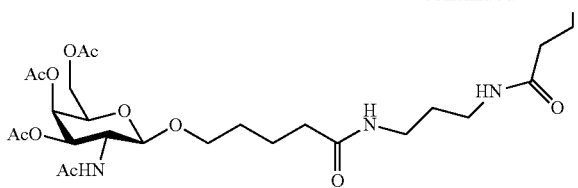
27
1. DCA, DCM
2. DCI, NMI, ACN
   Phosphoramidite
   building block 1a
3. Capping
4. t-BuOOH
DNA/RNA automated synthesizer
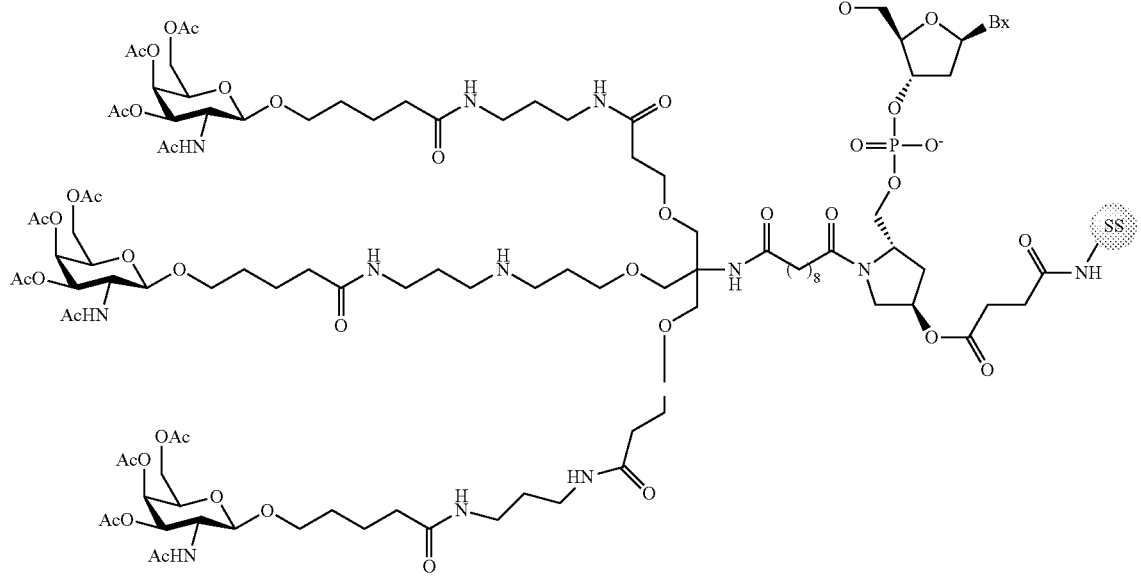
28
1. DCA, DCM
2. DCI, NMI, ACN
   Phosphoramidite
   building blocks
3. Capping
4. xanthane hydride or t-BuOOH
5. Et$_3$N/CH$_3$CN (1:1)
6. Aqueous NH$_3$ (cleavage)
DNA/RNA automated synthesizer -continued
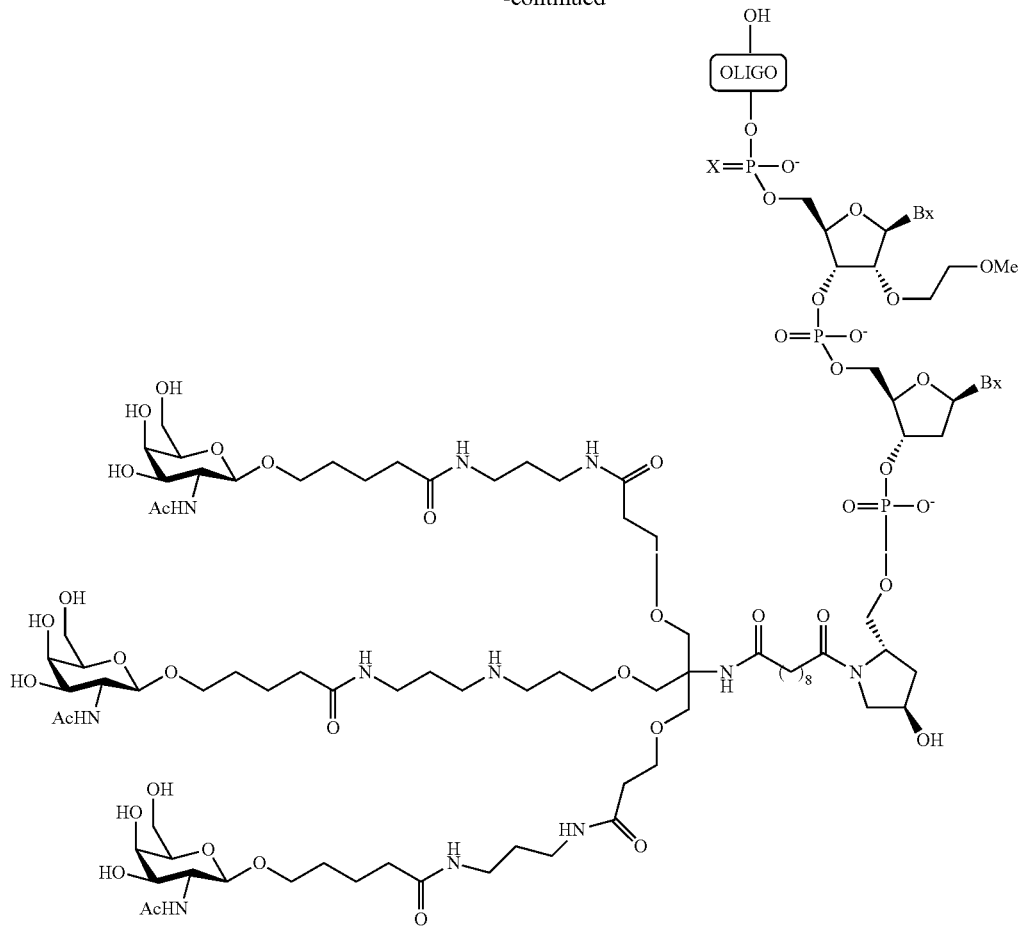
29
Bx = Heterocyclic base
X = O or S
Wherein the protected GalNAc₃-1 has the structure:
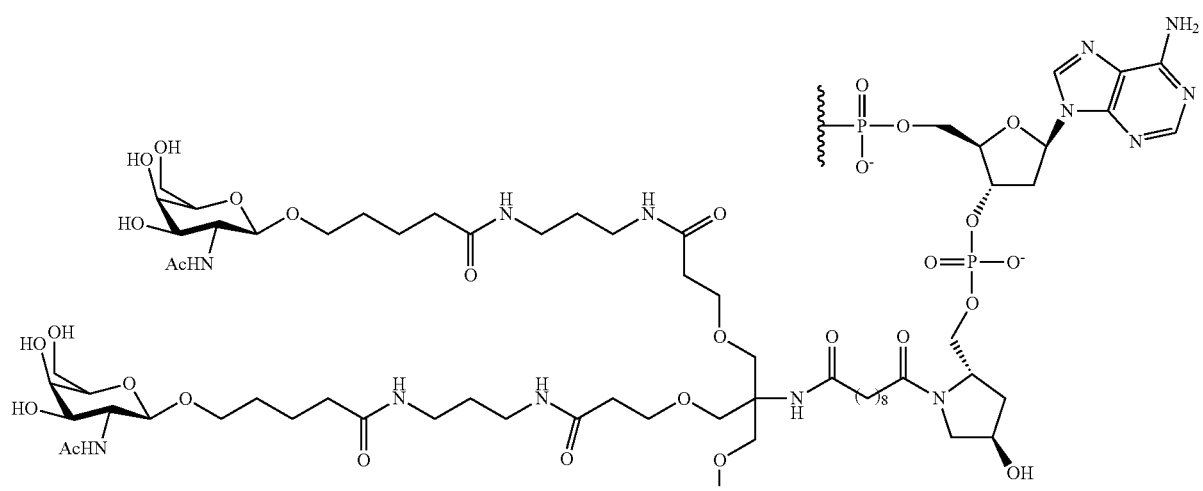

-continued

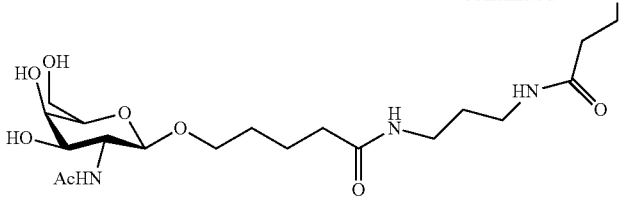

The GalNAc₃ cluster portion of the conjugate group GalNAc₃-1 (GalNAc₃-1$_a$) can be combined with any cleavable moiety to provide a variety of conjugate groups. Wherein GalNAc₃-1$_a$ has the formula:

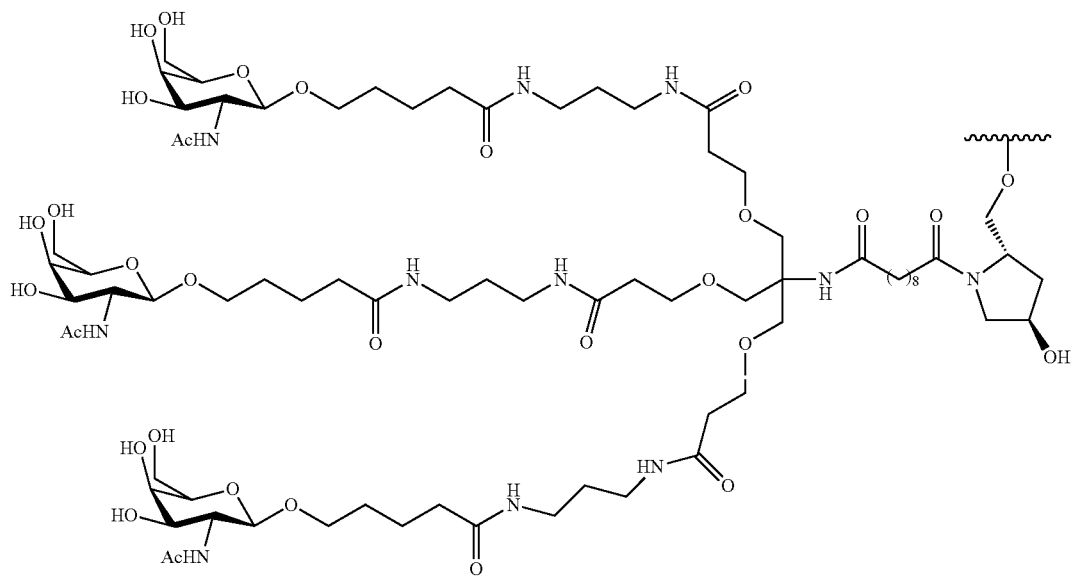

The solid support bound protected GalNAc₃-1, Compound 25, was prepared as per the procedures illustrated in Example 7. Oligomeric Compound 29 comprising GalNAc₃-1 at the 3' terminus was prepared using standard procedures in automated DNA/RNA synthesis (see Dupouy et al., *Angew. Chem. Int. Ed.,* 2006, 45, 3623-3627). Phosphoramidite building blocks, Compounds 1 and 1a were prepared as per the procedures illustrated in Example 1. The phosphoramidites illustrated are meant to be representative and not intended to be limiting as other phosphoramidite building blocks can be used to prepare oligomeric compounds having a predetermined sequence and composition.

The order and quantity of phosphoramidites added to the solid support can be adjusted to prepare gapped oligomeric compounds as described herein. Such gapped oligomeric compounds can have predetermined composition and base sequence as dictated by any given target.

Example 10

General Preparation Conjugated ASOs Comprising GalNAc₃-1 at the 5' Terminus, Compound 34

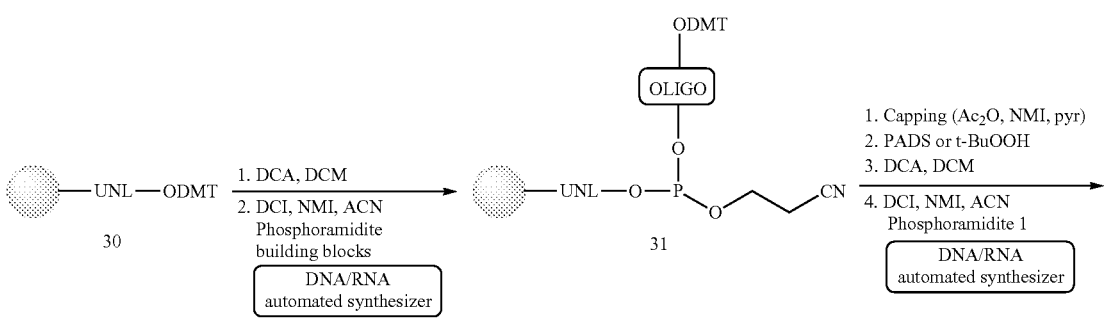

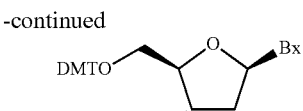
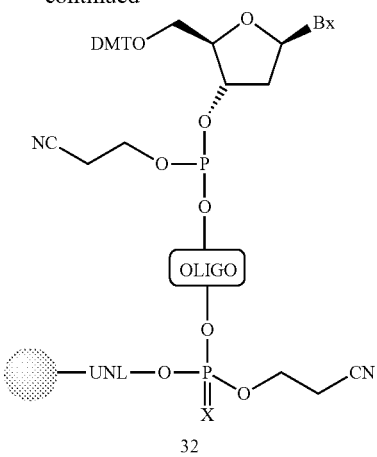
32
1. Capping (Ac₂O, NMI, pyr)
2. t-BuOOH
3. DCA, DCM
4. DCI, NMI, ACN
   Phosphoramidite 26
   DNA/RNA automated synthesizer
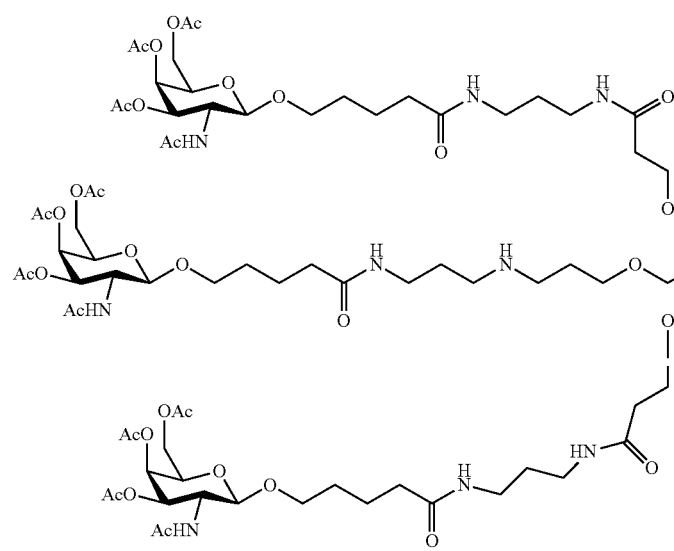
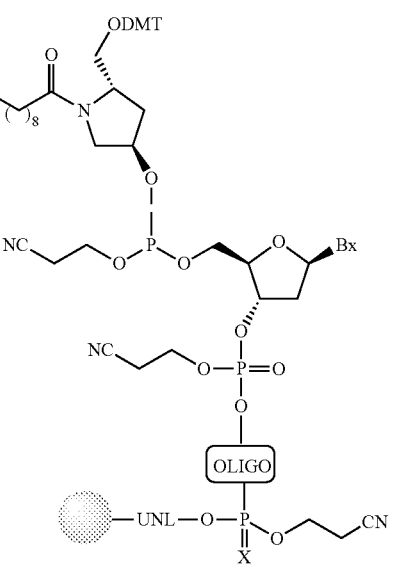
33
1. Capping (Ac₂O, NMI, pyr)
2. t-BuOOH
3. Et₃N:CH₃CN (1:1 v/v)
4. DCA, DCM
5. NH₄, rt (cleavage)
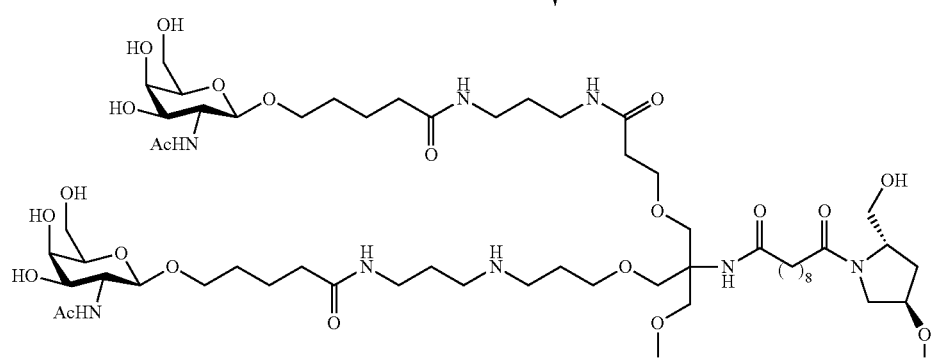

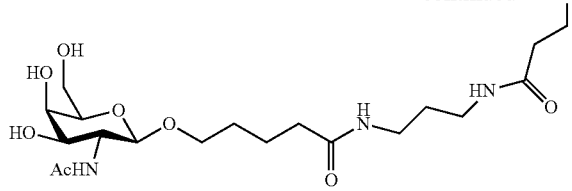

34

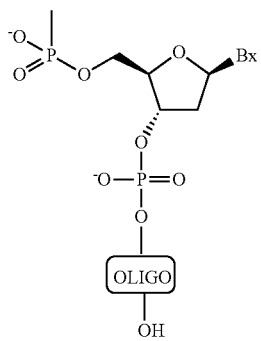

The Unylinker™ 30 is commercially available. Oligomeric Compound 34 comprising a GalNAc₃-1 cluster at the 5' terminus is prepared using standard procedures in automated DNA/RNA synthesis (see Dupouy et al., *Angew. Chem. Int. Ed.*, 2006, 45, 3623-3627). Phosphoramidite building blocks, Compounds 1 and 1a were prepared as per the procedures illustrated in Example 1. The phosphoramidites illustrated are meant to be representative and not intended to be limiting as other phosphoramidite building blocks can be used to prepare an oligomeric compound having a predetermined sequence and composition. The order and quantity of phosphoramidites added to the solid support can be adjusted to prepare gapped oligomeric compounds as described herein. Such gapped oligomeric compounds can have predetermined composition and base sequence as dictated by any given target.

Example 11

Preparation of Compound 39

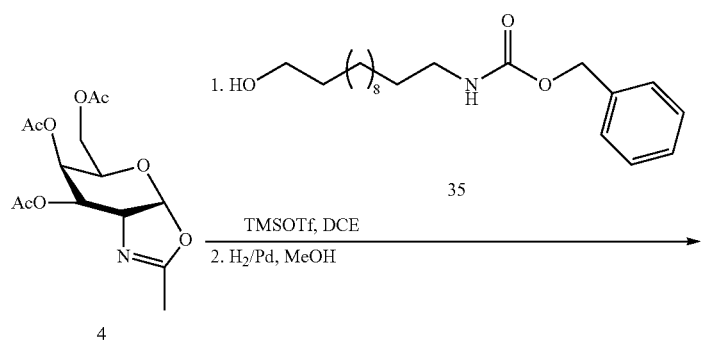

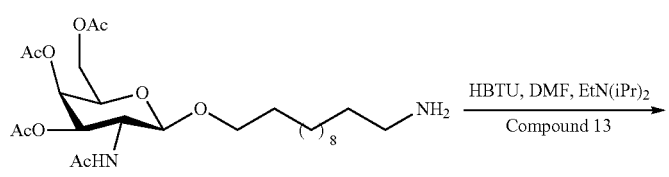

-continued
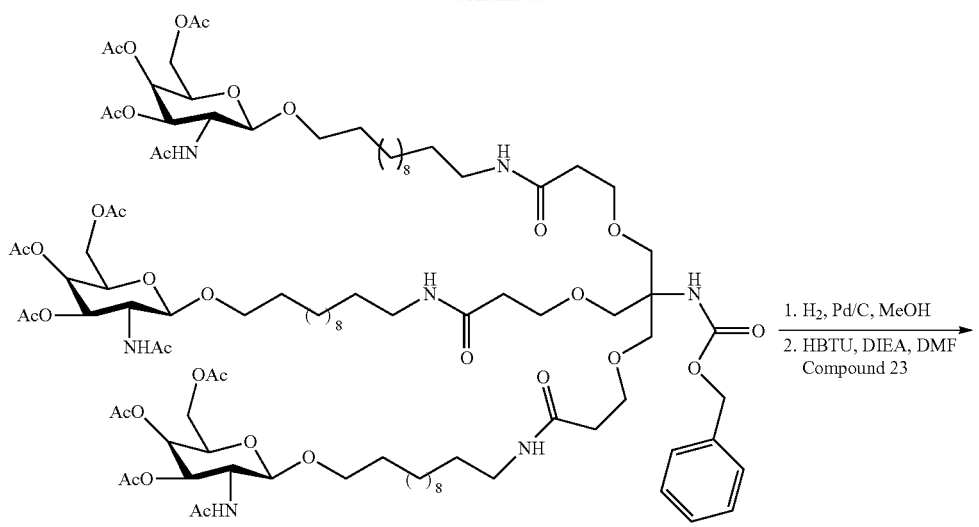
37
1. H₂, Pd/C, MeOH
2. HBTU, DIEA, DMF
   Compound 23
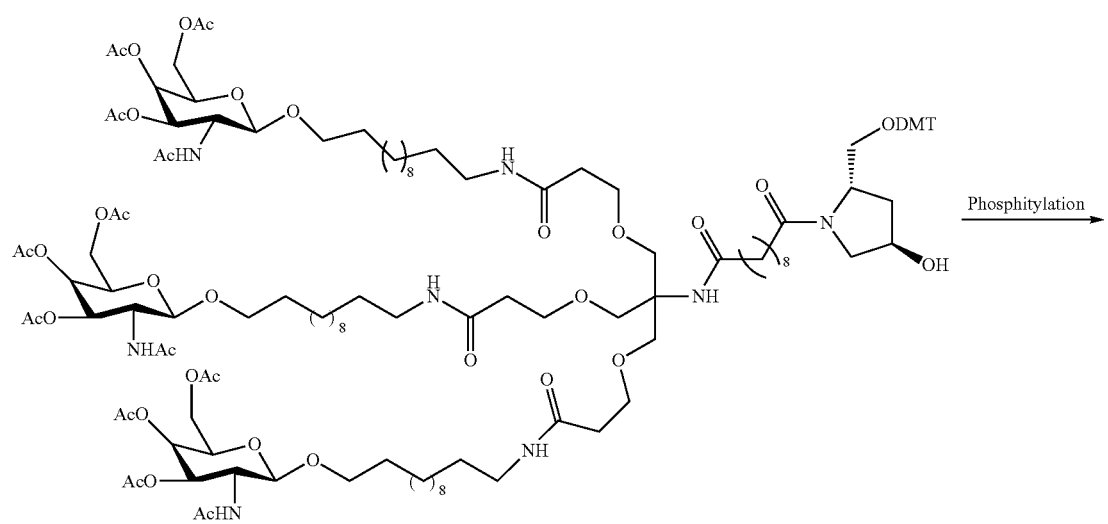
38
Phosphitylation
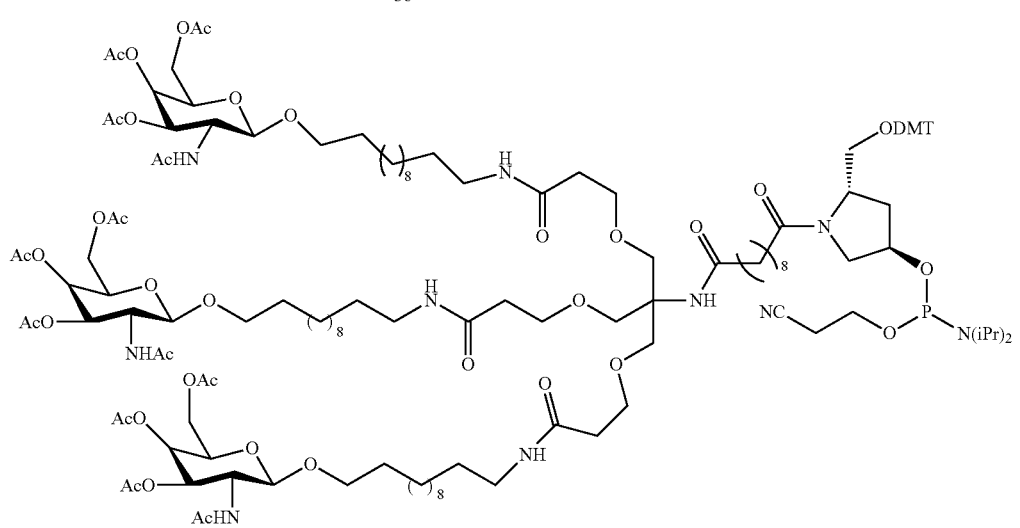
39

Compounds 4, 13 and 23 were prepared as per the procedures illustrated in Examples 2, 4, and 5. Compound 35 is prepared using similar procedures published in Rouchaud et al., *Eur. J. Org. Chem.*, 2011, 12, 2346-2353.
Example 12
Preparation of Compound 40
Compound 38 is prepared as per the procedures illustrated in Example 11.
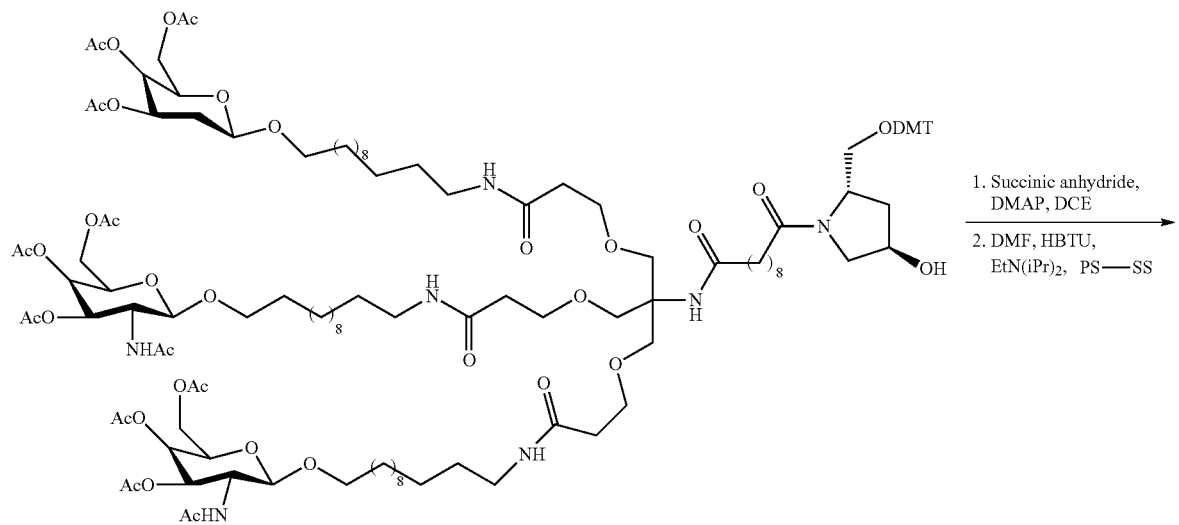
38
1. Succinic anhydride, DMAP, DCE
2. DMF, HBTU, EtN(iPr)$_2$, PS—SS
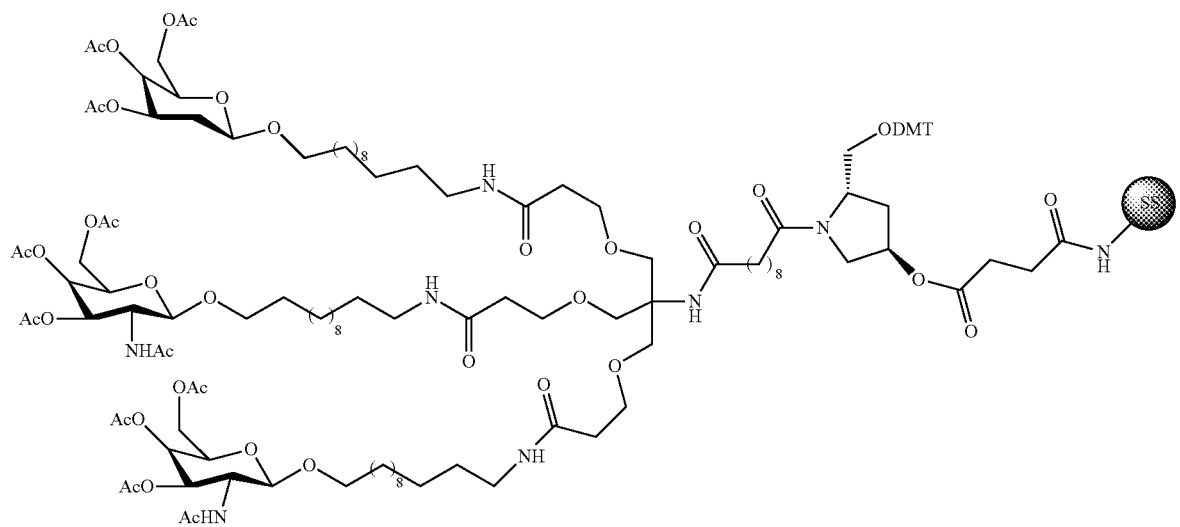
40

Example 13
Preparation of Compound 44
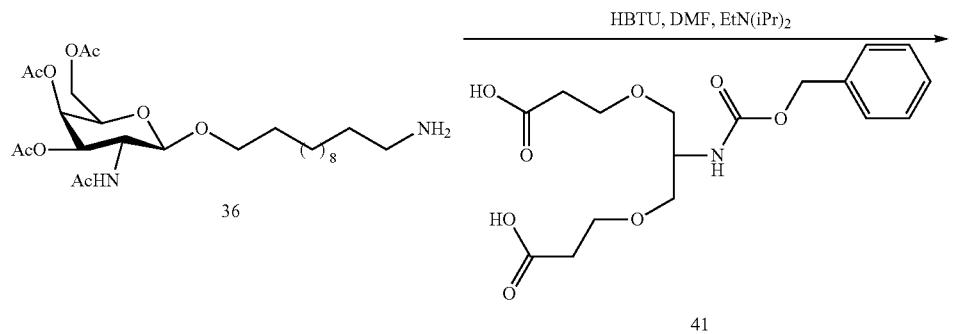
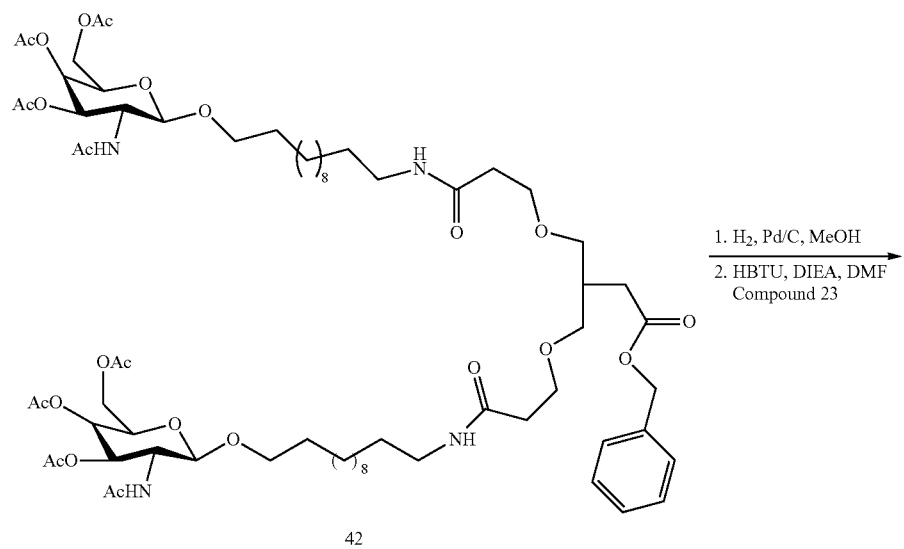
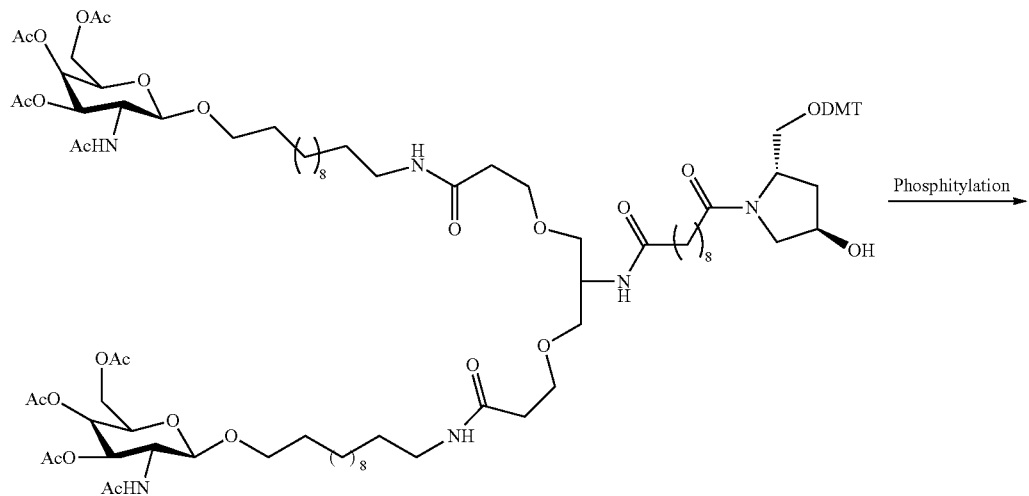

-continued
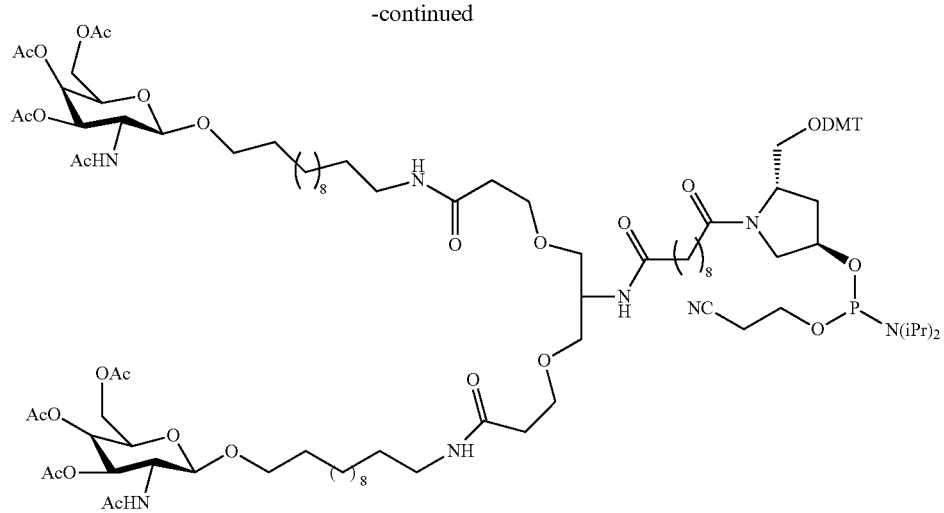
44
Compounds 23 and 36 are prepared as per the procedures illustrated in Examples 5 and 11. Compound 41 is prepared using similar procedures published in WO 2009082607.
Example 14
Preparation of Compound 45
Compound 43 is prepared as per the procedures illustrated in Example 13.
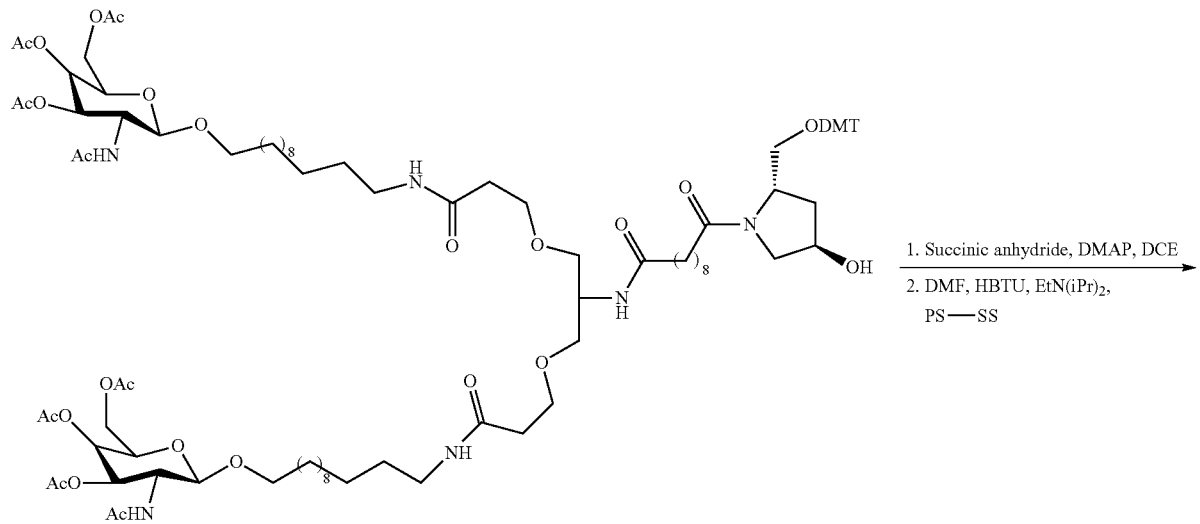
43

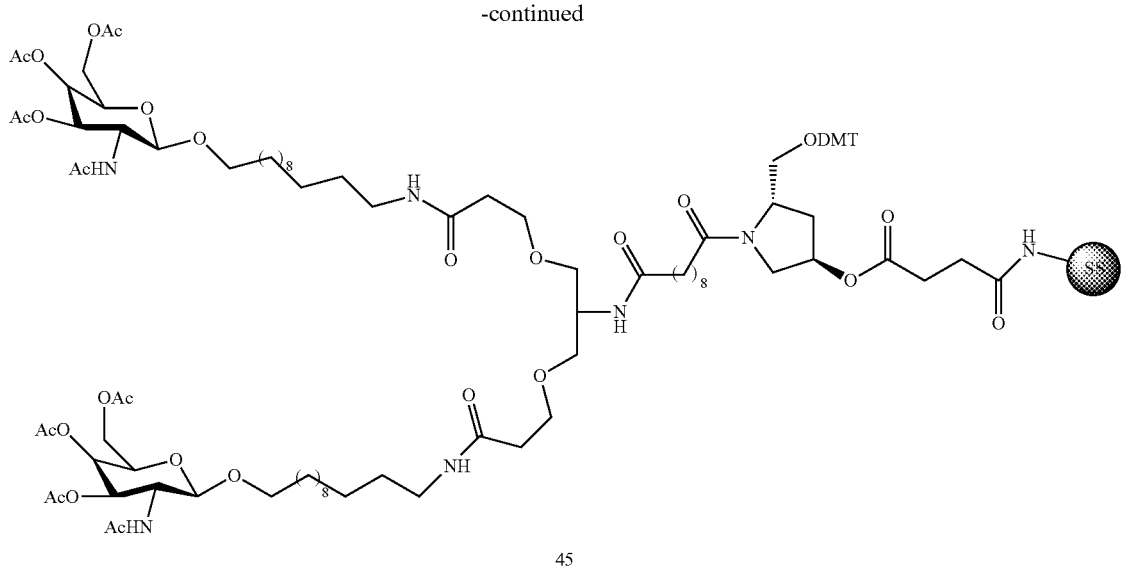
45
Example 15
Preparation of Compound 47
Compound 46 is commercially available.
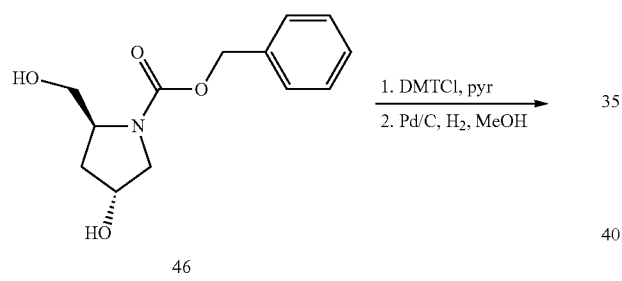
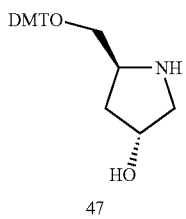
Example 16
Preparation of Compound 53
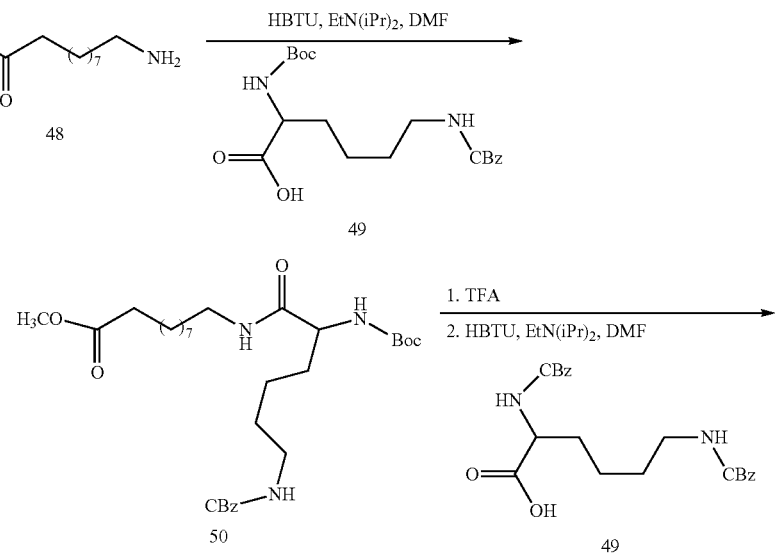

-continued
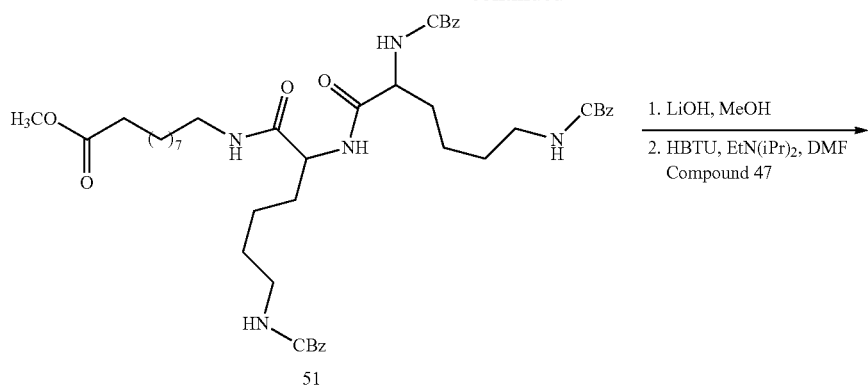
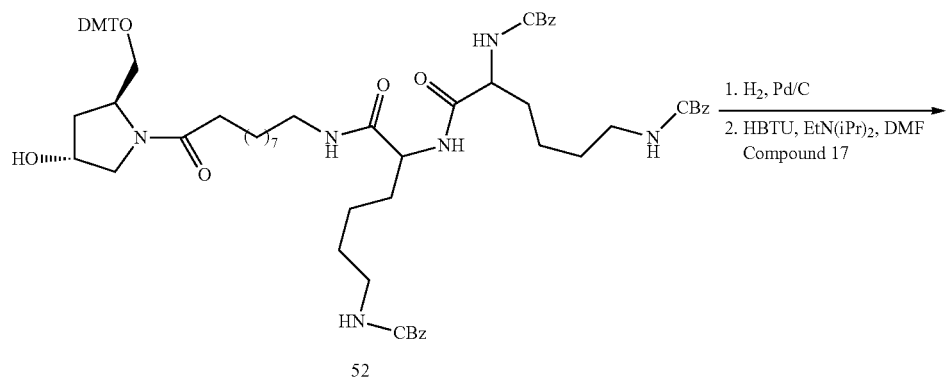
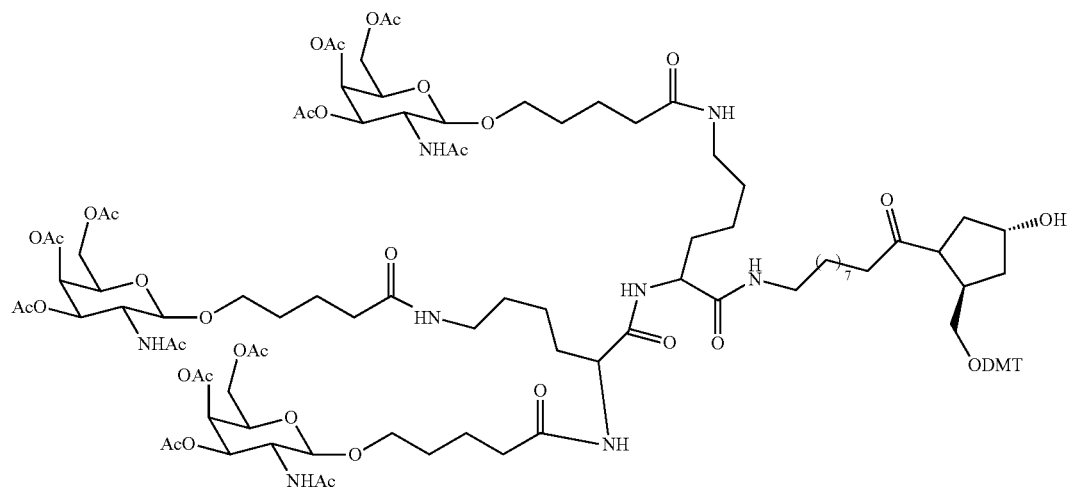

Compounds 48 and 49 are commercially available. Compounds 17 and 47 are prepared as per the procedures illustrated in Examples 4 and 15.
Example 17
Preparation of Compound 54
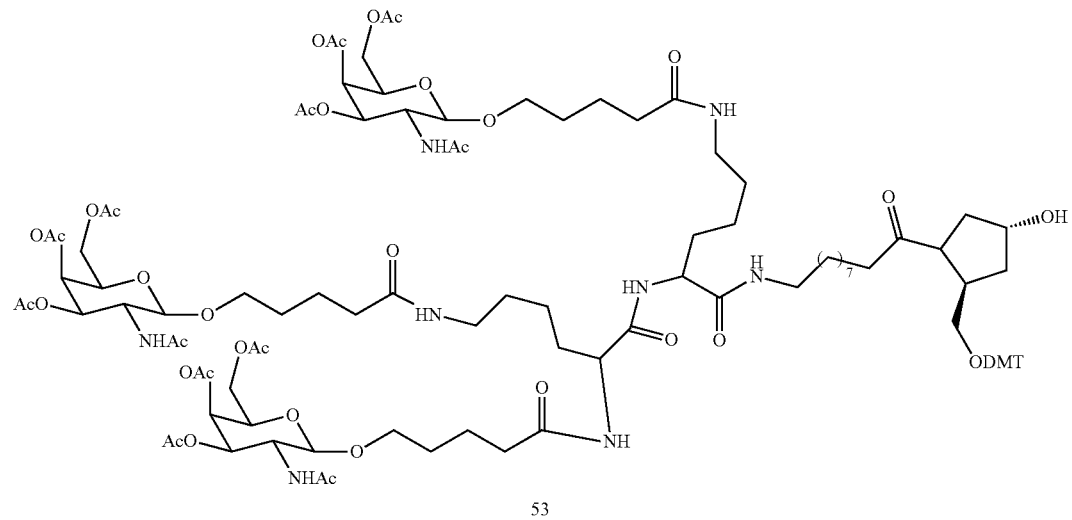
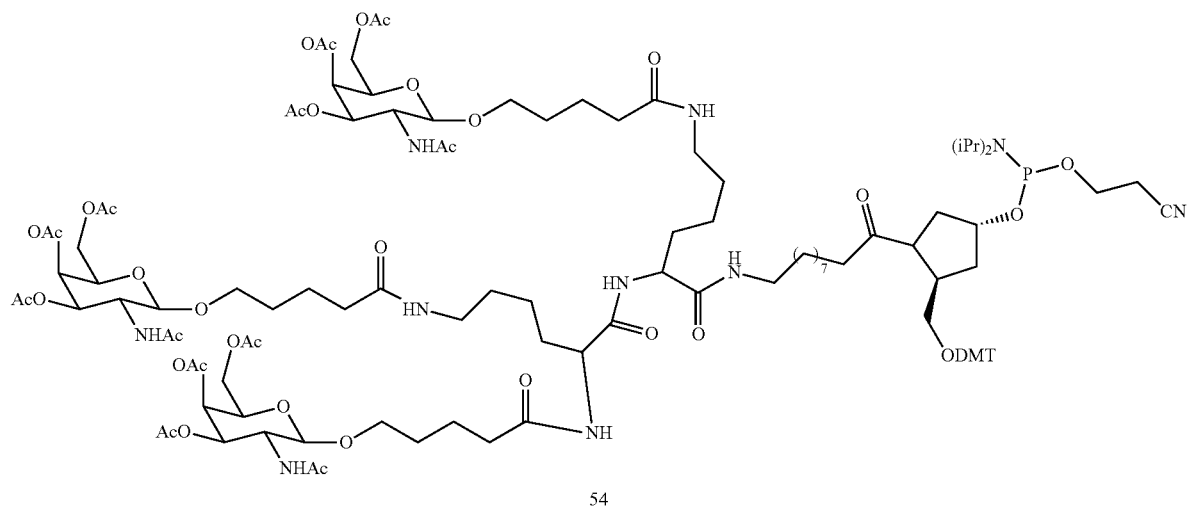
Compound 53 is prepared as per the procedures illustrated in Example 16.
Example 18
Preparation of Compound 55
Compound 53 is prepared as per the procedures illustrated in Example 16.

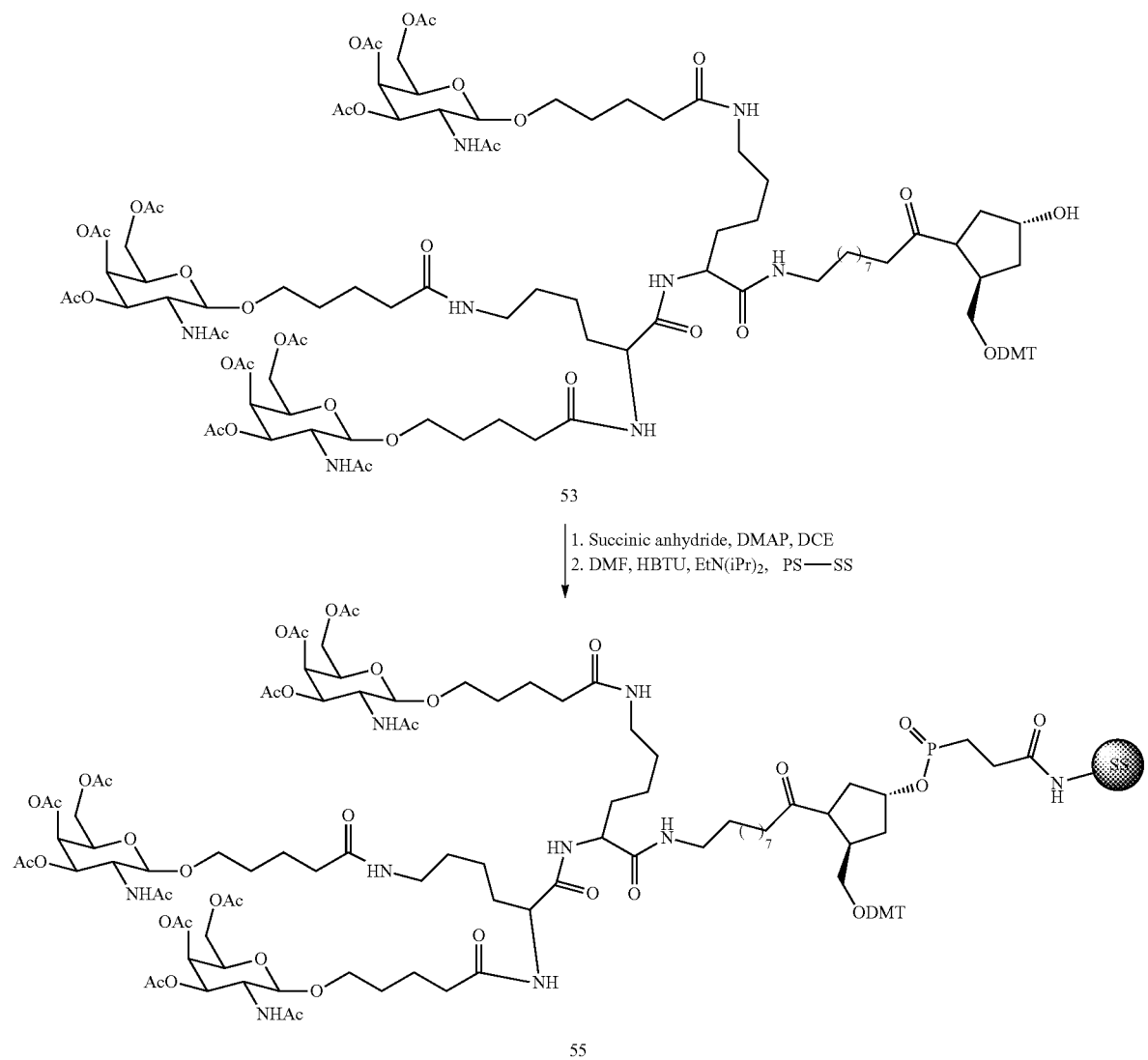

Example 19

General Method for the Preparation of Conjugated ASOs Comprising GalNAc₃-1 at the 3' Position Via Solid Phase Techniques (Preparation of ISIS 647535, 647536 and 651900)

Unless otherwise stated, all reagents and solutions used for the synthesis of oligomeric compounds are purchased from commercial sources. Standard phosphoramidite building blocks and solid support are used for incorporation nucleoside residues which include for example T, A, G, and $^mC$ residues. A 0.1 M solution of phosphoramidite in anhydrous acetonitrile was used for β-D-2'-deoxyribonucleoside and 2'-MOE.

The ASO syntheses were performed on ABI 394 synthesizer (1-2 μmol scale) or on GE Healthcare Bioscience ÄKTA oligopilot synthesizer (40-200 μmol scale) by the phosphoramidite coupling method on an GalNAc₃-1 loaded VIMAD solid support (110 μmol/g, Guzaev et al., 2003) packed in the column. For the coupling step, the phosphoramidites were delivered 4 fold excess over the loading on the solid support and phosphoramidite condensation was carried out for 10 min. All other steps followed standard protocols supplied by the manufacturer. A solution of 6% dichloroacetic acid in toluene was used for removing dimethoxytrityl (DMT) group from 5'-hydroxyl group of the nucleotide. 4,5-Dicyanoimidazole (0.7 M) in anhydrous $CH_3CN$ was used as activator during coupling step. Phosphorothioate linkages were introduced by sulfurization with 0.1 M solution of xanthane hydride in 1:1 pyridine/$CH_3CN$ for a contact time of 3 minutes. A solution of 20% tert-butylhydroperoxide in $CH_3CN$ containing 6% water was used as an oxidizing agent to provide phosphodiester internucleoside linkages with a contact time of 12 minutes.

After the desired sequence was assembled, the cyanoethyl phosphate protecting groups were deprotected using a 1:1 (v/v) mixture of triethylamine and acetonitrile with a contact time of 45 minutes. The solid-support bound ASOs were suspended in aqueous ammonia (28-30 wt %) and heated at 55° C. for 6 h.

The unbound ASOs were then filtered and the ammonia was boiled off. The residue was purified by high pressure liquid chromatography on a strong anion exchange column (GE Healthcare Bioscience, Source 30Q, 30 µm, 2.54×8 cm, A=100 mM ammonium acetate in 30% aqueous CH$_3$CN, B=1.5 M NaBr in A, 0-40% of B in 60 min, flow 14 mL min-1, λ=260 nm). The residue was desalted by HPLC on a reverse phase column to yield the desired ASOs in an isolated yield of 15-30% based on the initial loading on the solid support. The ASOs were characterized by ion-pair-HPLC coupled MS analysis with Agilent 1100 MSD system.

Antisense oligonucleotides not comprising a conjugate were synthesized using standard oligonucleotide synthesis procedures well known in the art.

Using these methods, three separate antisense compounds targeting ApoC III were prepared. As summarized in Table 17, below, each of the three antisense compounds targeting ApoC III had the same nucleobase sequence; ISIS 304801 is a 5-10-5 MOE gapmer having all phosphorothioate linkages; ISIS 647535 is the same as ISIS 304801, except that it had a GalNAc$_3$-1 conjugated at its 3'end; and ISIS 647536 is the same as ISIS 647535 except that certain internucleoside linkages of that compound are phosphodiester linkages. As further summarized in Table 17, two separate antisense compounds targeting SRB-1 were synthesized. ISIS 440762 was a 2-10-2 cEt gapmer with all phosphorothioate internucleoside linkages; ISIS 651900 is the same as ISIS 440762, except that it included a GalNAc$_3$-1 at its 3'-end.

describe a conjugate group by separately providing its cluster and its cleavable moiety.

Example 20

Dose-Dependent Antisense Inhibition of Human ApoC III in huApoC III Transgenic Mice ISIS 304801 and ISIS 647535, each targeting human ApoC III and described above, were separately tested and evaluated in a dose-dependent study for their ability to inhibit human ApoC III in human ApoC III transgenic mice.

Treatment

Human ApoCIII transgenic mice were maintained on a 12-hour light/dark cycle and fed ad libitum Teklad lab chow. Animals were acclimated for at least 7 days in the research facility before initiation of the experiment. ASOs were prepared in PBS and sterilized by filtering through a 0.2 micron filter. ASOs were dissolved in 0.9% PBS for injection.

Human ApoC III transgenic mice were injected intraperitoneally once a week for two weeks with ISIS 304801 or 647535 at 0.08, 0.25, 0.75, 2.25 or 6.75 µmol/kg, or with PBS as a control. Each treatment group consisted of 4 animals. Forty-eight hours after the administration of the last

TABLE 17

Modified ASO targeting ApoC III and SRB-1

| ASO | Sequence (5' to 3') | Target | CalCd Mass | Observed Mass | SEQ ID No. |
|---|---|---|---|---|---|
| ISIS 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$ T$_{es}$T$_{es}$T$_{es}$A$_{es}$T$_{e}$ | ApoC III | 7165.4 | 7164.4 | 2296 |
| ISIS 647535 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_{eo}$A$_{do'}$-GalNAc$_3$-1$_a$ | ApoC III | 9239.5 | 9237.8 | 2297 |
| ISIS 647536 | A$_{es}$G$_{eo}$$^m$C$_{eo}$T$_{eo}$T$_{eo}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{eo}$T$_{eo}$T$_{es}$A$_{es}$T$_{eo}$A$_{do'}$-GalNAc$_3$-1$_a$ | ApoC III | 9142.9 | 9140.8 | 2297 |
| ISIS 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{k}$ | SRB-1 | 4647.0 | 4646.4 | 2298 |
| ISIS 651900 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ko}$A$_{do'}$-GalNAc$_3$-1$_a$ | SRB-1 | 6721.1 | 6719.4 | 2299 |

Subscripts: "e" indicates 2'-MOE modified nucleoside; "d" indicates ß-D-2'-deoxyribonucleoside; "k" indicates 6'-(S)—CH$_3$ bicyclic nucleoside (e.g. cEt); "s" indicates phosphorothioate internucleoside linkages (PS); "o" indicates phosphodiester internucleoside linkages (PO); and "o'" indicates —O—P(=O)(OH)—. Superscript "m" indicates 5-methylcytosines. "GalNAc$_3$-1" indicates a conjugate group having the structure shown previously in Example 9. Note that GalNAc$_3$-1 comprises a cleavable adenosine which links the ASO to remainder of the conjugate, which is designated "GalNAc$_3$-1$_a$." This nomenclature is used in the above table to show the full nucleobase sequence, including the adenosine, which is part of the conjugate. Thus, in the above table, the sequences could also be listed as ending with "GalNAc$_3$-1" with the "A$_{do}$" omitted. This convention of using the subscript "a" to indicate the portion of a conjugate group lacking a cleavable nucleoside or cleavable moiety is used throughout these Examples. This portion of a conjugate group lacking the cleavable moiety is referred to herein as a "cluster" or "conjugate cluster" or "GalNAc$_3$ cluster." In certain instances it is convenient to dose, blood was drawn from each mouse and the mice were sacrificed and tissues were collected.

ApoC III mRNA Analysis

ApoC III mRNA levels in the mice's livers were determined using real-time PCR and RIBOGREEN® RNA quantification reagent (Molecular Probes, Inc. Eugene, Oreg.) according to standard protocols. ApoC III mRNA levels were determined relative to total RNA (using Ribogreen), prior to normalization to PBS-treated control. The results below are presented as the average percent of ApoC III mRNA levels for each treatment group, normalized to PBS-treated control and are denoted as "% PBS". The half maximal effective dosage (ED$_{50}$) of each ASO is also presented in Table 18, below.

As illustrated, both antisense compounds reduced ApoC III RNA relative to the PBS control. Further, the antisense compound conjugated to GalNAc$_3$-1 (ISIS 647535) was substantially more potent than the antisense compound lacking the GalNAc$_3$-1 conjugate (ISIS 304801).

TABLE 18

Effect of ASO treatment on ApoC III mRNA levels in human ApoC III transgenic mice

| ASO | Dose (μmol/kg) | % PBS | ED$_{50}$ (μmol/kg) | 3' Conjugate | Internucleoside linkage/Length | SEQ ID No. |
|---|---|---|---|---|---|---|
| PBS | 0 | 100 | — | — | — | |
| ISIS 304801 | 0.08 | 95 | 0.77 | None | PS/20 | 2296 |
| | 0.75 | 42 | | | | |
| | 2.25 | 32 | | | | |
| | 6.75 | 19 | | | | |
| ISIS 647535 | 0.08 | 50 | 0.074 | GalNAc$_3$-1 | PS/20 | 2297 |
| | 0.75 | 15 | | | | |
| | 2.25 | 17 | | | | |
| | 6.75 | 8 | | | | |

ApoC III Protein Analysis (Turbidometric Assay)

Plasma ApoC III protein analysis was determined using procedures reported by Graham et al, Circulation Research, published online before print Mar. 29, 2013.

Approximately 100 μl of plasma isolated from mice was analyzed without dilution using an Olympus Clinical Analyzer and a commercially available turbidometric ApoC III assay (Kamiya, Cat# KAI-006, Kamiya Biomedical, Seattle, Wash.). The assay protocol was performed as described by the vendor.

As shown in the Table 19 below, both antisense compounds reduced ApoC III protein relative to the PBS control. Further, the antisense compound conjugated to GalNAc$_3$-1 (ISIS 647535) was substantially more potent than the antisense compound lacking the GalNAc$_3$-1 conjugate (ISIS 304801).

TABLE 19

Effect of ASO treatment on ApoC III plasma protein levels in human ApoC III transgenic mice

| ASO | Dose (μmol/kg) | % PBS | ED$_{50}$ (μmol/kg) | 3' Conjugate | Internucleoside Linkage/Length | SEQ ID No. |
|---|---|---|---|---|---|---|
| PBS | 0 | 100 | — | — | — | |
| ISIS 304801 | 0.08 | 86 | 0.73 | None | PS/20 | 2296 |
| | 0.75 | 51 | | | | |
| | 2.25 | 23 | | | | |
| | 6.75 | 13 | | | | |
| ISIS 647535 | 0.08 | 72 | 0.19 | GalNAc$_3$-1 | PS/20 | 2297 |
| | 0.75 | 14 | | | | |
| | 2.25 | 12 | | | | |
| | 6.75 | 11 | | | | |

Plasma triglycerides and cholesterol were extracted by the method of Bligh and Dyer (Bligh, E. G. and Dyer, W. J. Can. J. Biochem. Physiol. 37: 911-917, 1959)(Bligh, E and Dyer, W, *Can J Biochem Physiol,* 37, 911-917, 1959)(Bligh, E and Dyer, W, *Can J Biochem Physiol,* 37, 911-917, 1959) and measured by using a Beckmann Coulter clinical analyzer and commercially available reagents.

The triglyceride levels were measured relative to PBS injected mice and are denoted as "% PBS". Results are presented in Table 20. As illustrated, both antisense compounds lowered triglyceride levels. Further, the antisense compound conjugated to GalNAc$_3$-1 (ISIS 647535) was substantially more potent than the antisense compound lacking the GalNAc$_3$-1 conjugate (ISIS 304801).

TABLE 20

Effect of ASO treatment on triglyceride levels in transgenic mice

| ASO | Dose (μmol/kg) | % PBS | ED$_{50}$ (μmol/kg) | 3' Conjugate | Internucleoside Linkage/Length | SEQ ID No. |
|---|---|---|---|---|---|---|
| PBS | 0 | 100 | — | — | — | |
| ISIS 304801 | 0.08 | 87 | 0.63 | None | PS/20 | 2296 |
| | 0.75 | 46 | | | | |
| | 2.25 | 21 | | | | |
| | 6.75 | 12 | | | | |
| ISIS 647535 | 0.08 | 65 | 0.13 | GalNAc$_3$-1 | PS/20 | 2297 |
| | 0.75 | 9 | | | | |
| | 2.25 | 8 | | | | |
| | 6.75 | 9 | | | | |

Plasma samples were analyzed by HPLC to determine the amount of total cholesterol and of different fractions of cholesterol (HDL and LDL). Results are presented in Tables 21 and 22. As illustrated, both antisense compounds lowered total cholesterol levels; both lowered LDL; and both raised HDL. Further, the antisense compound conjugated to GalNAc$_3$-1 (ISIS 647535) was substantially more potent than the antisense compound lacking the GalNAc$_3$-1 conjugate (ISIS 304801). An increase in HDL and a decrease in LDL levels is a cardiovascular beneficial effect of antisense inhibition of ApoC III.

TABLE 21

Effect of ASO treatment on total cholesterol levels in transgenic mice

| ASO | Dose (μmol/kg) | Total Cholesterol (mg/dL) | 3' Conjugate | Internucleoside Linkage/Length | SEQ ID No. |
|---|---|---|---|---|---|
| PBS | 0 | 257 | — | — | |
| ISIS 304801 | 0.08 | 226 | None | PS/20 | 2296 |
| | 0.75 | 164 | | | |
| | 2.25 | 110 | | | |
| | 6.75 | 82 | | | |
| ISIS 647535 | 0.08 | 230 | GalNAc$_3$-1 | PS/20 | 2297 |
| | 0.75 | 82 | | | |
| | 2.25 | 86 | | | |
| | 6.75 | 99 | | | |

TABLE 22

Effect of ASO treatment on HDL and LDL cholesterol levels in transgenic mice

| ASO | Dose (μmol/kg) | HDL (mg/dL) | LDL (mg/dL) | 3' Conjugate | Inter-nucleoside Linkage/Length | SEQ ID No. |
|---|---|---|---|---|---|---|
| PBS | 0 | 17 | 28 | — | — | |
| ISIS 304801 | 0.08 | 17 | 23 | None | PS/20 | 2296 |
| | 0.75 | 27 | 12 | | | |
| | 2.25 | 50 | 4 | | | |
| | 6.75 | 45 | 2 | | | |
| ISIS 647535 | 0.08 | 21 | 21 | GalNAc$_3$-1 | PS/20 | 2297 |
| | 0.75 | 44 | 2 | | | |
| | 2.25 | 50 | 2 | | | |
| | 6.75 | 58 | 2 | | | |

Pharmacokinetics Analysis (PK)

The PK of the ASOs was also evaluated. Liver and kidney samples were minced and extracted using standard protocols. Samples were analyzed on MSD1 utilizing IP-HPLC-MS. The tissue level (μg/g) of full-length ISIS 304801 and 647535 was measured and the results are provided in Table 23. As illustrated, liver concentrations of total full-length antisense compounds were similar for the two antisense compounds. Thus, even though the GalNAc$_3$-1-conjugated antisense compound is more active in the liver (as demonstrated by the RNA and protein data above), it is not present at substantially higher concentration in the liver. Indeed, the calculated EC$_{50}$ (provided in Table 23) confirms that the observed increase in potency of the conjugated compound cannot be entirely attributed to increased accumulation. This result suggests that the conjugate improved potency by a mechanism other than liver accumulation alone, possibly by improving the productive uptake of the antisense compound into cells.

The results also show that the concentration of GalNAc$_3$-1 conjugated antisense compound in the kidney is lower than that of antisense compound lacking the GalNAc conjugate. This has several beneficial therapeutic implications. For therapeutic indications where activity in the kidney is not sought, exposure to kidney risks kidney toxicity without corresponding benefit. Moreover, high concentration in kidney typically results in loss of compound to the urine resulting in faster clearance. Accordingly for non-kidney targets, kidney accumulation is undesired. These data suggest that GalNAc$_3$-1 conjugation reduces kidney accumulation.

Metabolites of ISIS 647535 were also identified and their masses were confirmed by high resolution mass spectrometry analysis. The cleavage sites and structures of the observed metabolites are shown below. The relative % of full length ASO was calculated using standard procedures and the results are presented in Table 23a. The major metabolite of ISIS 647535 was full-length ASO lacking the entire conjugate (i.e. ISIS 304801), which results from cleavage at cleavage site A, shown below. Further, additional metabolites resulting from other cleavage sites were also observed. These results suggest that introducing other cleavable bonds such as esters, peptides, disulfides, phosphoramidates or acyl-hydrazones between the GalNAc$_3$-1 sugar and the ASO, which can be cleaved by enzymes inside the cell, or which may cleave in the reductive environment of the cytosol, or which are labile to the acidic pH inside endosomes and lyzosomes, can also be useful.

TABLE 23a

Observed full length metabolites of ISIS 647535

| Metabolite | ASO | Cleavage site | Relative % |
|---|---|---|---|
| 1 | ISIS 304801 | A | 36.1 |
| 2 | ISIS 304801 + dA | B | 10.5 |
| 3 | ISIS 647535 minus [3 GalNAc] | C | 16.1 |
| 4 | ISIS 647535 minus [3 GalNAc + 1 5-hydroxy-pentanoic acid tether] | D | 17.6 |
| 5 | ISIS 647535 minus [2 GalNAc + 2 5-hydroxy-pentanoic acid tether] | D | 9.9 |
| 6 | ISIS 647535 minus [3 GalNAc + 3 5-hydroxy-pentanoic acid tether] | D | 9.8 |

TABLE 23

PK analysis of ASO treatment in transgenic mice

| ASO | Dose (μmol/kg) | Liver (μg/g) | Kidney (μg/g) | Liver EC$_{50}$ (μg/g) | 3' Conjugate | Internucleoside Linkage/Length | SEQ ID No. |
|---|---|---|---|---|---|---|---|
| ISIS 304801 | 0.1 | 5.2 | 2.1 | 53 | None | PS/20 | 2296 |
| | 0.8 | 62.8 | 119.6 | | | | |
| | 2.3 | 142.3 | 191.5 | | | | |
| | 6.8 | 202.3 | 337.7 | | | | |
| ISIS 647535 | 0.1 | 3.8 | 0.7 | 3.8 | GalNAc$_3$-1 | PS/20 | 2297 |
| | 0.8 | 72.7 | 34.3 | | | | |
| | 2.3 | 106.8 | 111.4 | | | | |
| | 6.8 | 237.2 | 179.3 | | | | |

Cleavage Sites
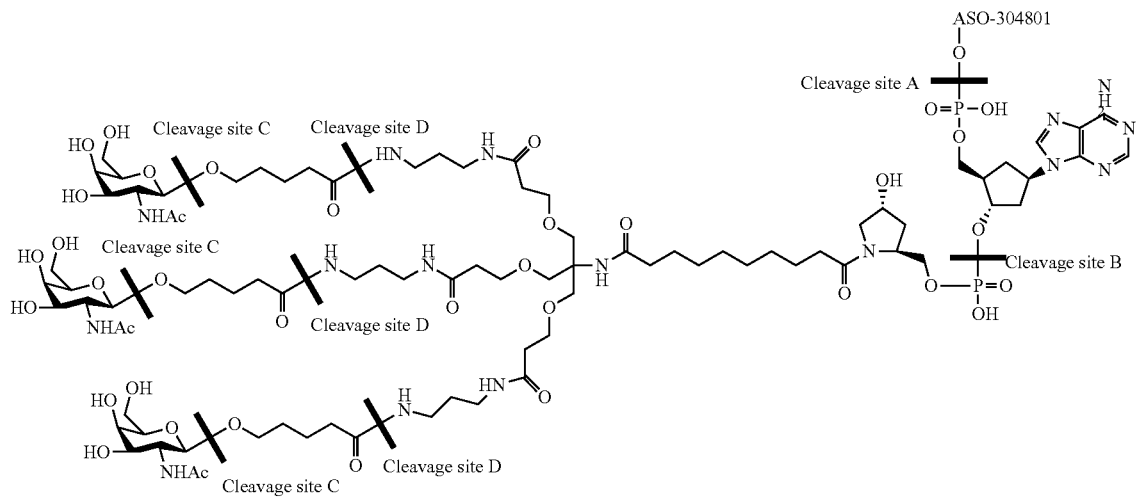
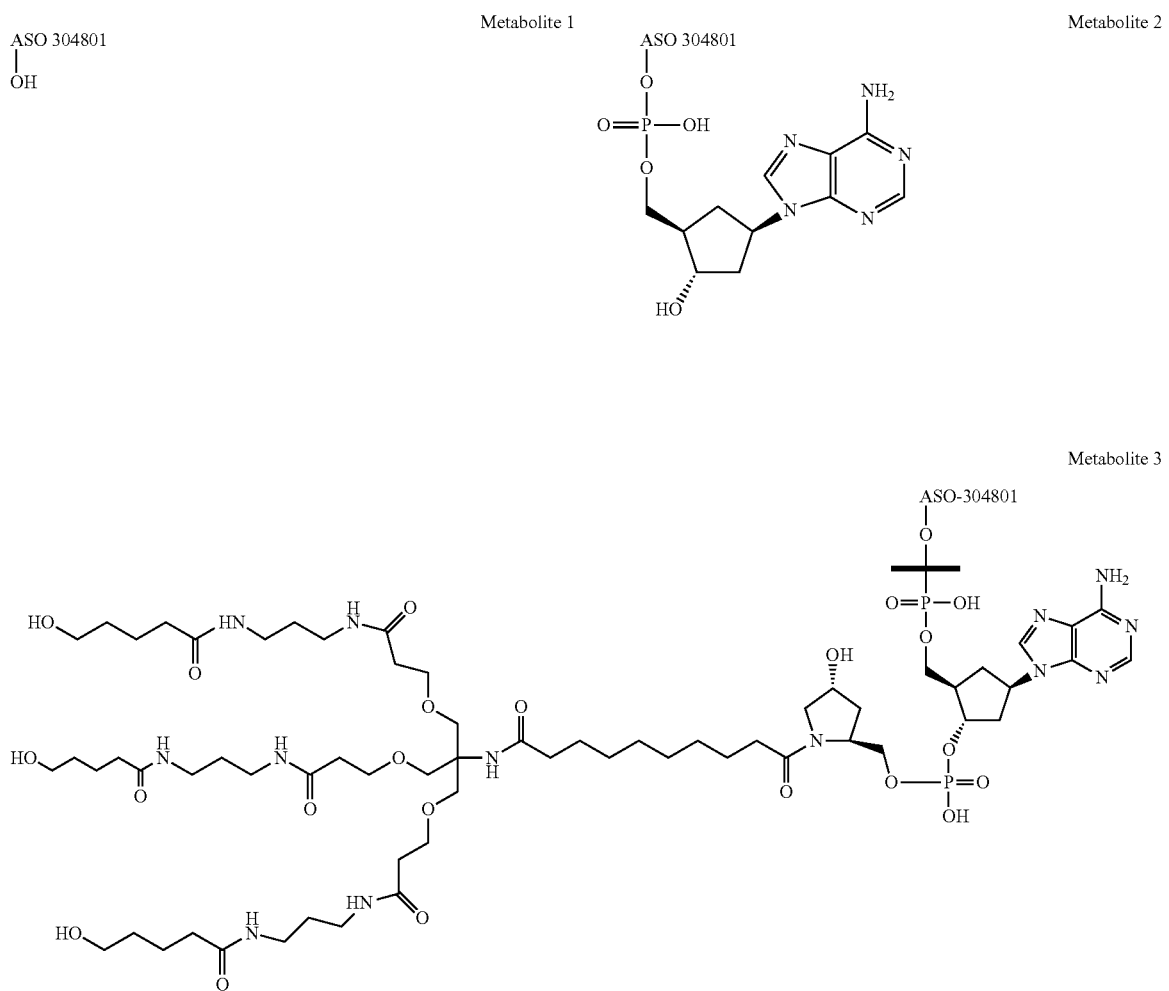

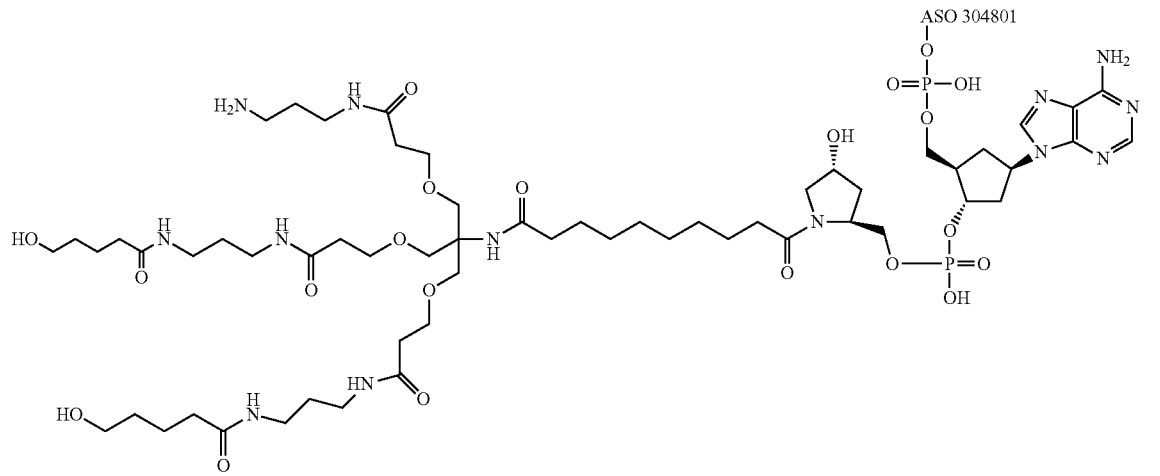
Metabolite 4
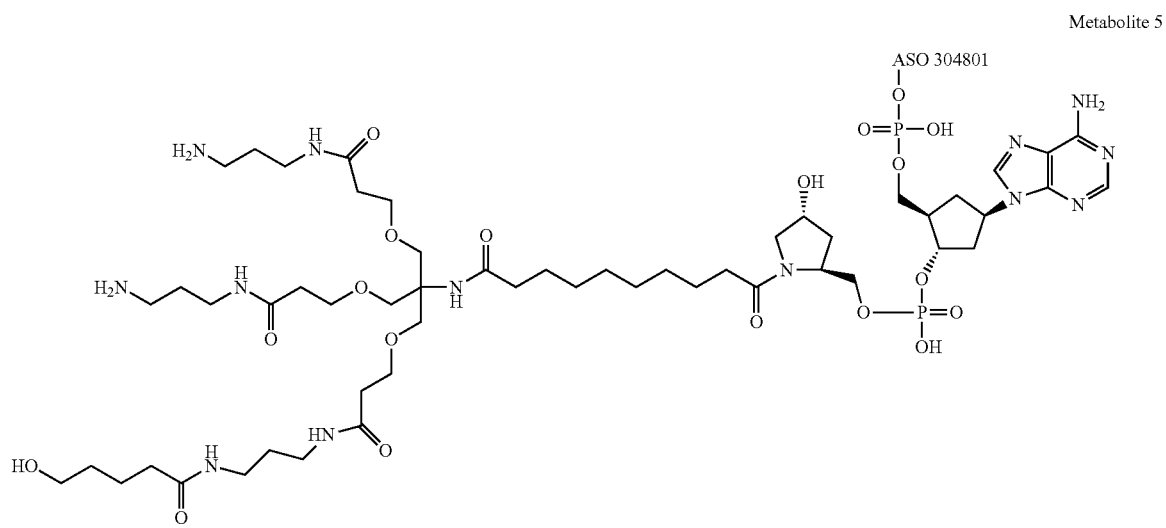
Metabolite 5
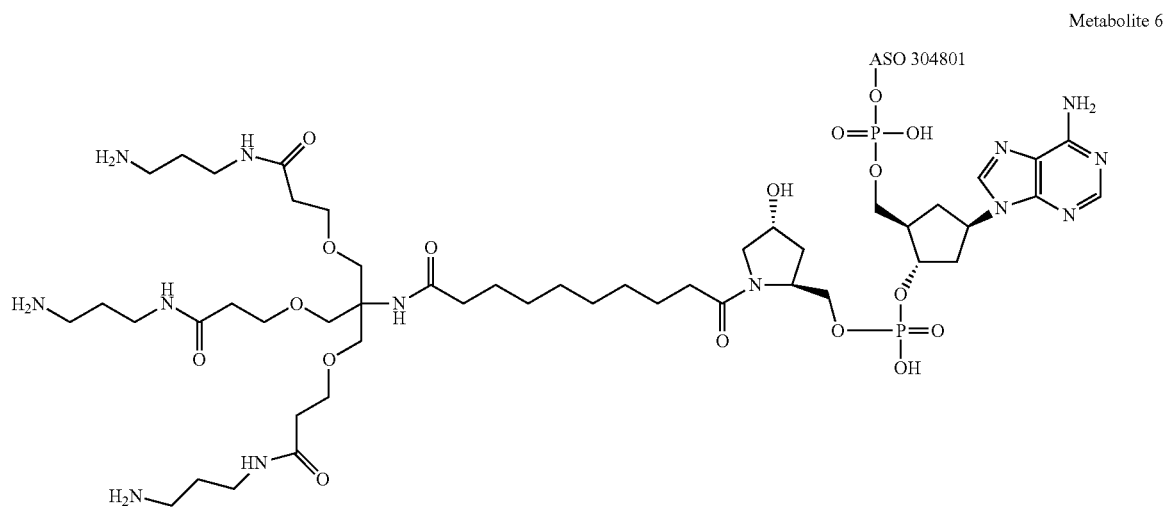
Metabolite 6

Example 21

Antisense Inhibition of Human ApoC III in Human ApoC III Transgenic Mice in Single Administration Study ISIS 304801, 647535 and 647536 each targeting human ApoC III and described in Table 17, were further evaluated in a single administration study for their ability to inhibit human ApoC III in human ApoC III transgenic mice.

Treatment

Human ApoCIII transgenic mice were maintained on a 12-hour light/dark cycle and fed ad libitum Teklad lab chow. Animals were acclimated for at least 7 days in the research facility before initiation of the experiment. ASOs were prepared in PBS and sterilized by filtering through a 0.2 micron filter. ASOs were dissolved in 0.9% PBS for injection.

Human ApoC III transgenic mice were injected intraperitoneally once at the dosage shown below with ISIS 304801, 647535 or 647536 (described above) or with PBS treated control. The treatment group consisted of 3 animals and the control group consisted of 4 animals. Prior to the treatment as well as after the last dose, blood was drawn from each mouse and plasma samples were analyzed. The mice were sacrificed 72 hours following the last administration.

Samples were collected and analyzed to determine the ApoC III mRNA and protein levels in the liver; plasma triglycerides; and cholesterol, including HDL and LDL fractions were assessed, as described above (Example 20). Data from those analyses are presented in Tables 24-28, below. Liver transaminase levels, alanine aminotransferase (ALT) and aspartate aminotransferase (AST), in serum were measured relative to saline injected mice using standard protocols. The ALT and AST levels showed that the antisense compounds were well tolerated at all administered doses.

These results show improvement in potency for antisense compounds comprising a GalNAc$_3$-1 conjugate at the 3' terminus (ISIS 647535 and 647536) compared to the antisense compound lacking a GalNAc$_3$-1 conjugate (ISIS 304801). Further, ISIS 647536, which comprises a GalNAc$_3$-1 conjugate and some phosphodiester linkages was as potent as ISIS 647535, which comprises the same conjugate, and all the internucleoside linkages within the ASO are phosphorothioate.

TABLE 24

Effect of ASO treatment on ApoC III mRNA levels in human ApoC III transgenic mice

| ASO | Dose (mg/kg) | % PBS | ED$_{50}$ (mg/kg) | 3' Conjugate | Internucleoside linkage/Length | SEQ ID No. |
|---|---|---|---|---|---|---|
| PBS | 0 | 99 | — | — | — | |
| ISIS 304801 | 1 | 104 | 13.2 | None | PS/20 | 2296 |
| | 3 | 92 | | | | |
| | 10 | 71 | | | | |
| | 30 | 40 | | | | |
| ISIS 647535 | 0.3 | 98 | 1.9 | GalNAc$_3$-1 | PS/20 | 2297 |
| | 1 | 70 | | | | |
| | 3 | 33 | | | | |
| | 10 | 20 | | | | |
| ISIS 647536 | 0.3 | 103 | 1.7 | GalNAc$_3$-1 | PS/PO/20 | 2297 |
| | 1 | 60 | | | | |
| | 3 | 31 | | | | |
| | 10 | 21 | | | | |

TABLE 25

Effect of ASO treatment on ApoC III plasma protein levels in human ApoC III transgenic mice

| ASO | Dose (mg/kg) | % PBS | ED$_{50}$ (mg/kg) | 3' Conjugate | Internucleoside Linkage/Length | SEQ ID No. |
|---|---|---|---|---|---|---|
| PBS | 0 | 99 | — | — | — | |
| ISIS 304801 | 1 | 104 | 23.2 | None | PS/20 | 2296 |
| | 3 | 92 | | | | |
| | 10 | 71 | | | | |
| | 30 | 40 | | | | |
| ISIS 647535 | 0.3 | 98 | 2.1 | GalNAc$_3$-1 | PS/20 | 2297 |
| | 1 | 70 | | | | |
| | 3 | 33 | | | | |
| | 10 | 20 | | | | |
| ISIS 647536 | 0.3 | 103 | 1.8 | GalNAc$_3$-1 | PS/PO/20 | 2297 |
| | 1 | 60 | | | | |
| | 3 | 31 | | | | |
| | 10 | 21 | | | | |

TABLE 26

Effect of ASO treatment on triglyceride levels in transgenic mice

| ASO | Dose (mg/kg) | % PBS | ED$_{50}$ (mg/kg) | 3' Conjugate | Internucleoside Linkage/Length | SEQ ID No. |
|---|---|---|---|---|---|---|
| PBS | 0 | 98 | — | — | — | |
| ISIS 304801 | 1 | 80 | 29.1 | None | PS/20 | 2296 |
| | 3 | 92 | | | | |
| | 10 | 70 | | | | |
| | 30 | 47 | | | | |
| ISIS 647535 | 0.3 | 100 | 2.2 | GalNAc$_3$-1 | PS/20 | 2297 |
| | 1 | 70 | | | | |
| | 3 | 34 | | | | |
| | 10 | 23 | | | | |
| ISIS 647536 | 0.3 | 95 | 1.9 | GalNAc$_3$-1 | PS/PO/20 | 2297 |
| | 1 | 66 | | | | |
| | 3 | 31 | | | | |
| | 10 | 23 | | | | |

TABLE 27

Effect of ASO treatment on total cholesterol levels in transgenic mice

| ASO | Dose (mg/kg) | % PBS | 3' Conjugate | Internucleoside Linkage/Length | SEQ ID No. |
|---|---|---|---|---|---|
| PBS | 0 | 96 | — | — | |
| ISIS 304801 | 1 | 104 | None | PS/20 | 2296 |
| | 3 | 96 | | | |
| | 10 | 86 | | | |
| | 30 | 72 | | | |
| ISIS 647535 | 0.3 | 93 | GalNAc$_3$-1 | PS/20 | 2297 |
| | 1 | 85 | | | |
| | 3 | 61 | | | |
| | 10 | 53 | | | |
| ISIS 647536 | 0.3 | 115 | GalNAc$_3$-1 | PS/PO/20 | 2297 |
| | 1 | 79 | | | |
| | 3 | 51 | | | |
| | 10 | 54 | | | |

TABLE 28

Effect of ASO treatment on HDL and LDL cholesterol levels in transgenic mice

| ASO | Dose (mg/kg) | HDL % PBS | LDL % PBS | 3' Conjugate | Internucleoside Linkage/Length | SEQ ID No. |
|---|---|---|---|---|---|---|
| PBS | 0 | 131 | 90 | — | — | |
| ISIS 304801 | 1 | 130 | 72 | None | PS/20 | 2296 |
| | 3 | 186 | 79 | | | |
| | 10 | 226 | 63 | | | |
| | 30 | 240 | 46 | | | |
| ISIS 647535 | 0.3 | 98 | 86 | GalNAc$_3$-1 | PS/20 | 2297 |
| | 1 | 214 | 67 | | | |
| | 3 | 212 | 39 | | | |
| | 10 | 218 | 35 | | | |
| ISIS 647536 | 0.3 | 143 | 89 | GalNAc$_3$-1 | PS/PO/20 | 2297 |
| | 1 | 187 | 56 | | | |
| | 3 | 213 | 33 | | | |
| | 10 | 221 | 34 | | | |

These results confirm that the GalNAc$_3$-1 conjugate improves potency of an antisense compound. The results also show equal potency of a GalNAc$_3$-1 conjugated antisense compounds where the antisense oligonucleotides have mixed linkages (ISIS 647536 which has six phosphodiester linkages) and a full phosphorothioate version of the same antisense compound (ISIS 647535).

Phosphorothioate linkages provide several properties to antisense compounds. For example, they resist nuclease digestion and they bind proteins resulting in accumulation of compound in the liver, rather than in the kidney/urine. These are desirable properties, particularly when treating an indication in the liver. However, phosphorothioate linkages have also been associated with an inflammatory response. Accordingly, reducing the number of phosphorothioate linkages in a compound is expected to reduce the risk of inflammation, but also lower concentration of the compound in liver, increase concentration in the kidney and urine, decrease stability in the presence of nucleases, and lower overall potency. The present results show that a GalNAc$_3$-1 conjugated antisense compound where certain phosphorothioate linkages have been replaced with phosphodiester linkages is as potent against a target in the liver as a counterpart having full phosphorothioate linkages. Such compounds are expected to be less proinflammatory (See Example 24 describing an experiment showing reduction of PS results in reduced inflammatory effect).

Example 22

Effect of GalNAc$_3$-1 Conjugated Modified ASO Targeting SRB-1 In Vivo

ISIS 440762 and 651900, each targeting SRB-1 and described in Table 17, were evaluated in a dose-dependent study for their ability to inhibit SRB-1 in Balb/c mice.
Treatment Six week old male Balb/c mice (Jackson Laboratory, Bar Harbor, Me.) were injected subcutaneously once at the dosage shown below with ISIS 440762, 651900 or with PBS treated control. Each treatment group consisted of 4 animals. The mice were sacrificed 48 hours following the final administration to determine the SRB-1 mRNA levels in liver using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS".

As illustrated in Table 29, both antisense compounds lowered SRB-1 mRNA levels. Further, the antisense compound comprising the GalNAc$_3$-1 conjugate (ISIS 651900) was substantially more potent than the antisense compound lacking the GalNAc$_3$-1 conjugate (ISIS 440762). These results demonstrate that the potency benefit of GalNAc$_3$-1 conjugates are observed using antisense oligonucleotides complementary to a different target and having different chemically modified nucleosides, in this instance modified nucleosides comprise constrained ethyl sugar moieties (a bicyclic sugar moiety).

TABLE 29

Effect of ASO treatment on SRB-1 mRNA levels in Balb/c mice

| ASO | Dose (mg/kg) | Liver % PBS | ED$_{50}$ (mg/kg) | 3' Conjugate | Internucleoside linkage/Length | SEQ ID No. |
|---|---|---|---|---|---|---|
| PBS | 0 | 100 | — | — | | |
| ISIS 440762 | 0.7 | 85 | 2.2 | None | PS/14 | 2298 |
| | 2 | 55 | | | | |
| | 7 | 12 | | | | |
| | 20 | 3 | | | | |
| ISIS 651900 | 0.07 | 98 | 0.3 | GalNAc$_3$-1 | PS/14 | 2299 |
| | 0.2 | 63 | | | | |
| | 0.7 | 20 | | | | |
| | 2 | 6 | | | | |
| | 7 | 5 | | | | |

Example 23

Human Peripheral Blood Mononuclear Cells (hPBMC) Assay Protocol

The hPBMC assay was performed using BD Vautainer CPT tube method. A sample of whole blood from volunteered donors with informed consent at US HealthWorks clinic (Faraday & El Camino Real, Carlsbad) was obtained and collected in 4-15 BD Vacutainer CPT 8 ml tubes (VWR Cat.# BD362753). The approximate starting total whole blood volume in the CPT tubes for each donor was recorded using the PBMC assay data sheet.

The blood sample was remixed immediately prior to centrifugation by gently inverting tubes 8-10 times. CPT tubes were centrifuged at rt (18-25° C.) in a horizontal (swing-out) rotor for 30 min. at 1500-1800 RCF with brake off (2700 RPM Beckman Allegra 6R). The cells were retrieved from the buffy coat interface (between Ficoll and polymer gel layers); transferred to a sterile 50 ml conical tube and pooled up to 5 CPT tubes/50 ml conical tube/donor. The cells were then washed twice with PBS (Ca$^{++}$, Mg$^{++}$ free; GIBCO). The tubes were topped up to 50 ml and mixed by inverting several times. The sample was then centrifuged at 330×g for 15 minutes at rt (1215 RPM in Beckman Allegra 6R) and aspirated as much supernatant as possible without disturbing pellet. The cell pellet was dislodged by gently swirling tube and resuspended cells in RPMI+10% FBS+pen/strep (~1 ml/10 ml starting whole blood volume). A 60 µl sample was pipette into a sample vial (Beckman Coulter) with 600 µl VersaLyse reagent (Beckman Coulter Cat# A09777) and was gently vortexed for 10-15 sec. The sample was allowed to incubate for 10 min. at rt and being mixed again before counting. The cell suspension was counted on Vicell XR cell viability analyzer (Beckman Coulter) using PBMC cell type (dilution factor of 1:11 was stored with other parameters). The live cell/ml and viability were recorded. The cell suspension was diluted to 1×10$^7$ live PBMC/ml in RPMI+10% FBS+pen/strep.

The cells were plated at 5×10$^5$ in 50 μl/well of 96-well tissue culture plate (Falcon Microtest). 50 μl/well of 2× concentration oligos/controls diluted in RPMI+10% FBS+ pen/strep. was added according to experiment template (100 μl/well total). Plates were placed on the shaker and allowed to mix for approx. 1 min. After being incubated for 24 hrs at 37° C.; 5% $CO_2$, the plates were centrifuged at 400×g for 10 minutes before removing the supernatant for MSD cytokine assay (i.e. human IL-6, IL-10, IL-8 and MCP-1).

Example 24

Evaluation of Proinflammatory Effects in hPBMC Assay for $GalNAc_3$-1 Conjugated ASOs The antisense oligonucleotides (ASOs) listed in Table 30 were evaluated for proinflammatory effect in hPBMC assay using the protocol described in Example 23. ISIS 353512 is an internal standard known to be a high responder for IL-6 release in the assay. The hPBMCs were isolated from fresh, volunteered donors and were treated with ASOs at 0, 0.0128, 0.064, 0.32, 1.6, 8, 40 and 200 μM concentrations. After a 24 hr treatment, the cytokine levels were measured.

The levels of IL-6 were used as the primary readout. The $EC_{50}$ and $E_{max}$ was calculated using standard procedures. Results are expressed as the average ratio of $E_{max}/EC_{50}$ from two donors and is denoted as "$E_{max}/EC_{50}$." The lower ratio indicates a relative decrease in the proinflammatory response and the higher ratio indicates a relative increase in the proinflammatory response.

With regard to the test compounds, the least proinflammatory compound was the PS/PO linked ASO (ISIS 616468). The $GalNAc_3$-1 conjugated ASO, ISIS 647535 was slightly less proinflammatory than its non-conjugated counterpart ISIS 304801. These results indicate that incorporation of some PO linkages reduces proinflammatory reaction and addition of a $GalNAc_3$-1 conjugate does not make a compound more proinflammatory and may reduce proinflammatory response. Accordingly, one would expect that an antisense compound comprising both mixed PS/PO linkages and a $GalNAc_3$-1 conjugate would produce lower proinflammatory responses relative to full PS linked antisense compound with or without a $GalNAc_3$-1 conjugate. These results show that $GalNAc_3$1 conjugated antisense compounds, particularly those having reduced PS content are less proinflammatory.

Together, these results suggest that a $GalNAc_3$-1 conjugated compound, particularly one with reduced PS content, can be administered at a higher dose than a counterpart full PS antisense compound lacking a $GalNAc_3$-1 conjugate. Since half-life is not expected to be substantially different for these compounds, such higher administration would result in less frequent dosing. Indeed such administration could be even less frequent, because the $GalNAc_3$-1 conjugated compounds are more potent (See Examples 20-22) and re-dosing is necessary once the concentration of a compound has dropped below a desired level, where such desired level is based on potency.

TABLE 30

Modified ASOs

| ASO | Sequence (5' to 3') | Target | SEQ ID No. |
|---|---|---|---|
| ISIS 104838 | $G_{es}{}^mC_{es}T_{es}G_{es}A_{es}T_{ds}T_{ds}A_{ds}G_{ds}A_{ds}G_{ds}$ $A_{ds}G_{ds}A_{ds}G_{ds}G_{es}T_{es}{}^mC_{es}{}^mC_{es}{}^mC_e$ | TNFα | 2300 |
| ISIS 353512 | $T_{es}{}^mC_{es}{}^mC_{es}{}^mC_{ds}A_{ds}T_{ds}T_{ds}T_{ds}{}^mC_{ds}A_{ds}G_{ds}$ $G_{ds}A_{ds}G_{ds}A_{ds}{}^mC_{ds}{}^mC_{ds}T_{es}G_{es}G_e$ | CRP | 2301 |
| ISIS 304801 | $A_{es}G_{es}{}^mC_{es}T_{es}T_{es}{}^mC_{ds}T_{ds}T_{ds}G_{ds}T_{ds}$ ${}^mC_{ds}{}^mC_{ds}A_{ds}G_{ds}{}^mC_{ds}\,T_{es}T_{es}T_{es}A_{es}T_e$ | ApoC III | 2296 |
| ISIS 647535 | $A_{es}G_{es}{}^mC_{es}T_{es}T_{es}{}^mC_{ds}T_{ds}T_{ds}G_{ds}T_{ds}$ ${}^mC_{ds}{}^mC_{ds}A_{ds}G_{ds}{}^mC_{ds}T_{es}T_{es}T_{es}A_{es}T_{eo}A_{do'}$-$GalNAc_3$-$1_a$ | ApoC III | 2297 |
| ISIS 616468 | $A_{es}G_{eo}{}^mC_{eo}T_{eo}T_{eo}{}^mC_{ds}T_{ds}T_{ds}G_{ds}T_{ds}$ ${}^mC_{ds}{}^mC_{ds}A_{ds}G_{ds}{}^mC_{ds}T_{eo}T_{eo}T_{es}A_{es}T_e$ | ApoC III | 2296 |

Subscripts: "e" indicates 2'-MOE modified nucleoside; "d" indicates β-D-2'-deoxyribonucleoside; "k" indicates 6'-(S)—$CH_3$ bicyclic nucleoside (e.g. cEt); "s" indicates phosphorothioate internucleoside linkages (PS); "o" indicates phosphodiester internucleoside linkages (PO); and "o'" indicates —O—P(=O)(OH)—. Superscript "m" indicates 5-methylcytosines. "$A_{do'}$-$GalNAc_3$-1." indicates a conjugate having the structure $GalNAc_3$-1 shown in Example 9 attached to the 3'-end of the antisense oligonucleotide, as indicated.

TABLE 31

Proinflammatory Effect of ASOs targeting ApoC III in hPBMC assay

| ASO | $EC_{50}$ (µM) | $E_{max}$ (µM) | $E_{max}/EC_{50}$ | 3' Conjugate | Internucleoside Linkage/Length | SEQ ID No. |
|---|---|---|---|---|---|---|
| ISIS 353512 (high responder) | 0.01 | 265.9 | 26,590 | None | PS/20 | 2301 |
| ISIS 304801 | 0.07 | 106.55 | 1,522 | None | PS/20 | 2296 |
| ISIS 647535 | 0.12 | 138 | 1,150 | GalNAc₃-1 | PS/20 | 2297 |
| ISIS 616468 | 0.32 | 71.52 | 224 | None | PS/PO/20 | 2296 |

Example 25

Effect of GalNAc₃-1 Conjugated Modified ASO Targeting Human ApoC III In Vitro ISIS 304801 and 647535 described above were tested in vitro. Primary hepatocyte cells from transgenic mice at a density of 25,000 cells per well were treated with 0.03, 0.08, 0.24, 0.74, 2.22, 6.67 and 20 µM concentrations of modified oligonucleotides. After a treatment period of approximately 16 hours, RNA was isolated from the cells and mRNA levels were measured by quantitative real-time PCR and the hApoC III mRNA levels were adjusted according to total RNA content, as measured by RIBOGREEN.

The $IC_{50}$ was calculated using the standard methods and the results are presented in Table 32. As illustrated, comparable potency was observed in cells treated with ISIS 647535 as compared to the control, ISIS 304801.

TABLE 32

Modified ASO targeting human ApoC III in primary hepatocytes

| ASO | $IC_{50}$ (µM) | 3' Conjugate | Internucleoside linkage/Length | SEQ ID No. |
|---|---|---|---|---|
| ISIS 304801 | 0.44 | None | PS/20 | 2296 |
| ISIS 647535 | 0.31 | GalNAc₃-1 | PS/20 | 2297 |

In this experiment, the large potency benefits of GalNAc₃-1 conjugation that are observed in vivo were not observed in vitro. Subsequent free uptake experiments in primary hepatocytes in vitro did show increased potency of oligonucleotides comprising various GalNAc conjugates relative to oligonucleotides that lack the GalNAc conjugate (see Examples 60, 82, and 92).

Example 26

Effect of PO/PS Linkages on ApoC III ASO Activity

Human ApoC III transgenic mice were injected intraperitoneally once at 25 mg/kg of ISIS 304801, or ISIS 616468 (both described above) or with PBS treated control once per week for two weeks. The treatment group consisted of 3 animals and the control group consisted of 4 animals. Prior to the treatment as well as after the last dose, blood was drawn from each mouse and plasma samples were analyzed. The mice were sacrificed 72 hours following the last administration.

Samples were collected and analyzed to determine the ApoC III protein levels in the liver as described above (Example 20). Data from those analyses are presented in Table 33, below.

These results show reduction in potency for antisense compounds with PO/PS (ISIS 616468) in the wings relative to full PS (ISIS 304801).

TABLE 33

Effect of ASO treatment on ApoC III protein levels in human ApoC III transgenic mice

| ASO | Dose (mg/kg) | % PBS | 3' Conjugate | Internucleoside linkage/Length | SEQ ID No. |
|---|---|---|---|---|---|
| PBS | 0 | 99 | — | — | |
| ISIS 304801 | 25 mg/kg/wk for 2 wks | 24 | None | Full PS | 2296 |
| ISIS 616468 | 25 mg/kg/wk for 2 wks | 40 | None | 14 PS/6 PO | 2296 |

Example 27

Compound 56

Compound 56 is commercially available from Glen Research or may be prepared according to published procedures reported by Shchepinov et al., *Nucleic Acids Research*, 1997, 25(22), 4447-4454.

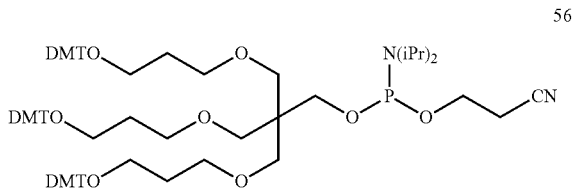

Example 28

Preparation of Compound 60

Compound 4 was prepared as per the procedures illustrated in Example 2. Compound 57 is commercially available. Compound 60 was confirmed by structural analysis.

Compound 57 is meant to be representative and not intended to be limiting as other monoprotected substituted or unsubstituted alkyl diols including but not limited to those presented in the specification herein can be used to prepare phosphoramidites having a predetermined composition.

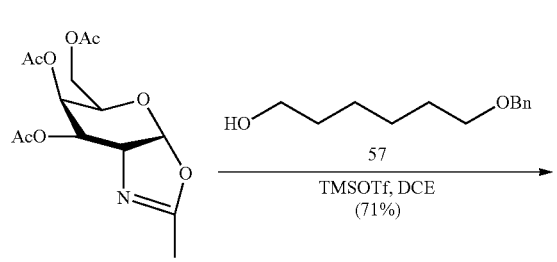
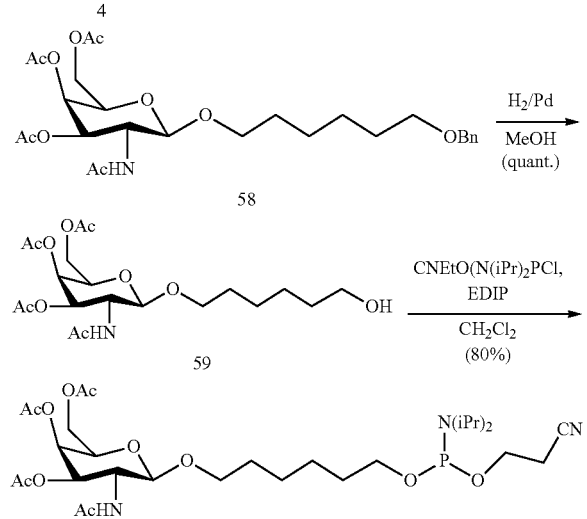

Example 29

Preparation of Compound 63

Compounds 61 and 62 are prepared using procedures similar to those reported by Tober et al., *Eur. J. Org. Chem.,* 2013, 3, 566-577; and Jiang et al., *Tetrahedron,* 2007, 63(19), 3982-3988.

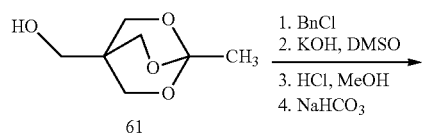
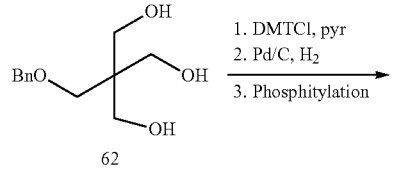
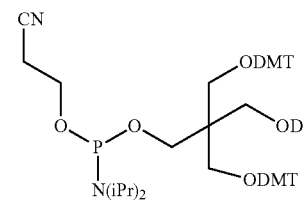

Alternatively, Compound 63 is prepared using procedures similar to those reported in scientific and patent literature by Kim et al., *Synlett,* 2003, 12, 1838-1840; and Kim et al., published PCT International Application, WO 2004063208.

Example 30

Preparation of Compound 63b

Compound 63a is prepared using procedures similar to those reported by Hanessian et al., *Canadian Journal of Chemistry,* 1996, 74(9), 1731-1737.

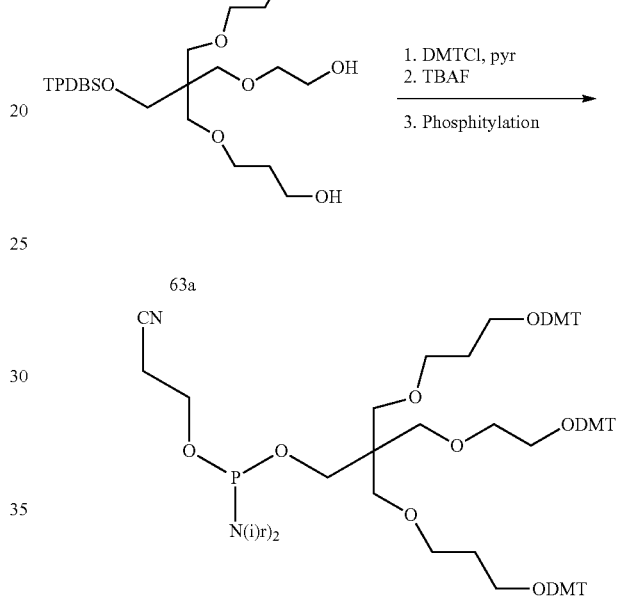

Example 31

Preparation of Compound 63d

Compound 63d is prepared using procedures similar to those reported by Chen et al., *Chinese Chemical Letters,* 1998, 9(5), 451-453.

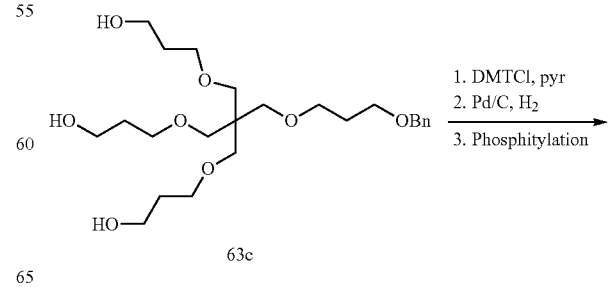

-continued

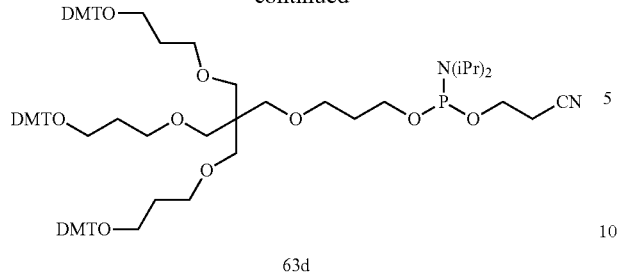

63d

Example 32

Preparation of Compound 67

Compound 64 was prepared as per the procedures illustrated in Example 2. Compound 65 is prepared using procedures similar to those reported by Or et al., published PCT International Application, WO 2009003009. The protecting groups used for Compound 65 are meant to be representative and not intended to be limiting as other protecting groups including but not limited to those presented in the specification herein can be used.

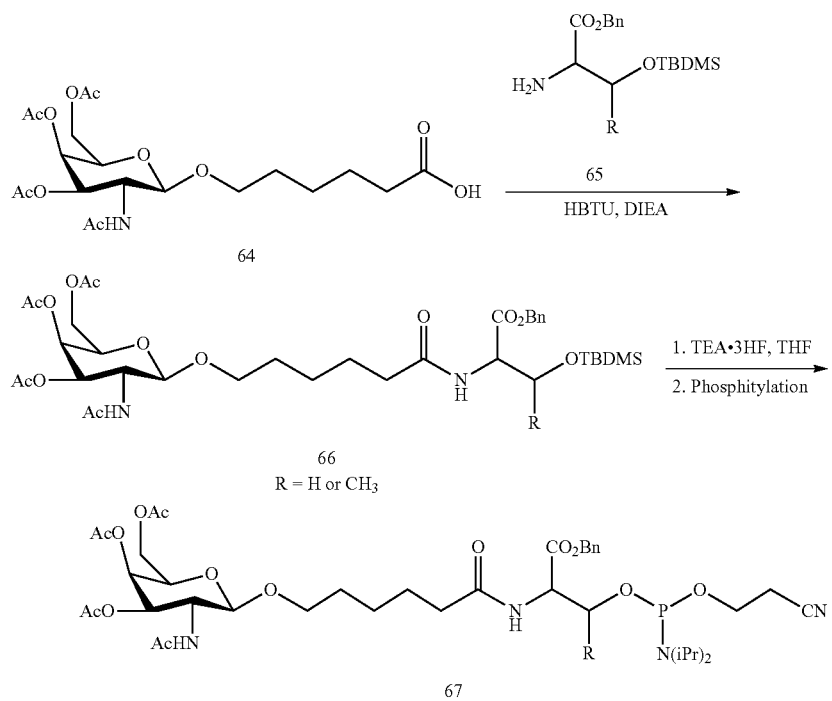

Example 33

Preparation of Compound 70

Compound 64 was prepared as per the procedures illustrated in Example 2. Compound 68 is commercially available. The protecting group used for Compound 68 is meant to be representative and not intended to be limiting as other protecting groups including but not limited to those presented in the specification herein can be used.

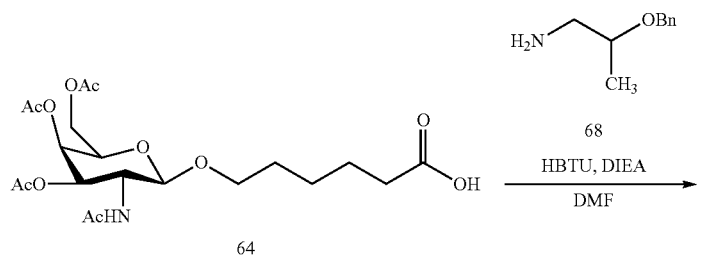

-continued
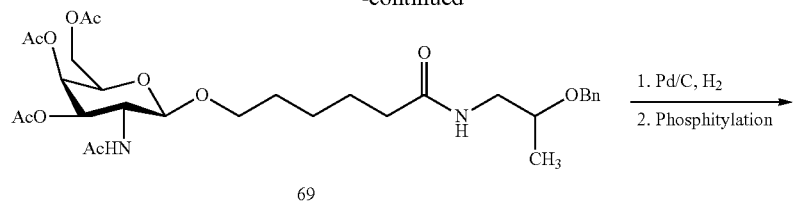
69
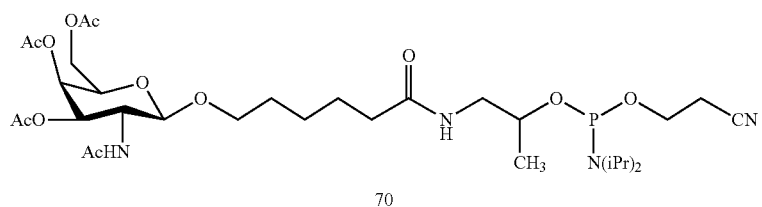
70
Example 34
Preparation of Compound 75a
Compound 75 is prepared according to published procedures reported by Shchepinov et al., *Nucleic Acids Research*, 1997, 25(22), 4447-4454.
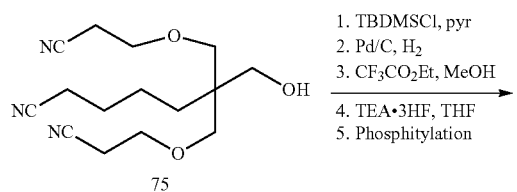
75
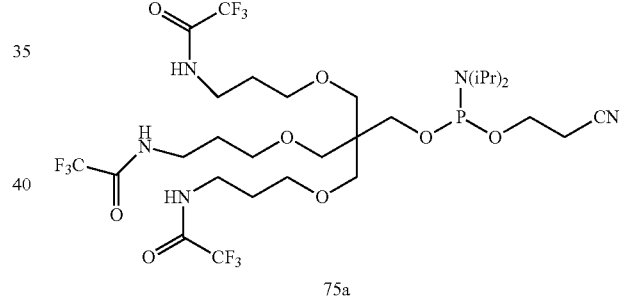
75a
Example 35
Preparation of Compound 79
Compound 76 was prepared according to published procedures reported by Shchepinov et al., *Nucleic Acids Research*, 1997, 25(22), 4447-4454.
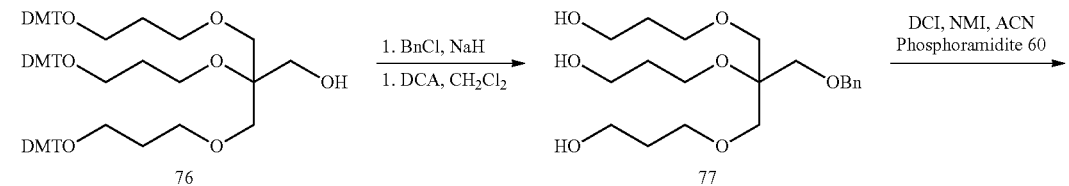

-continued
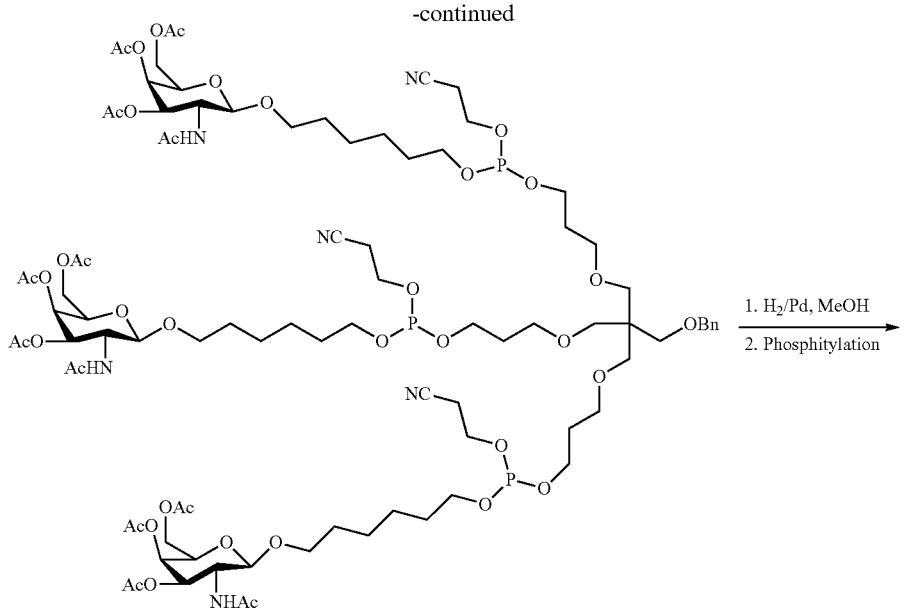
78
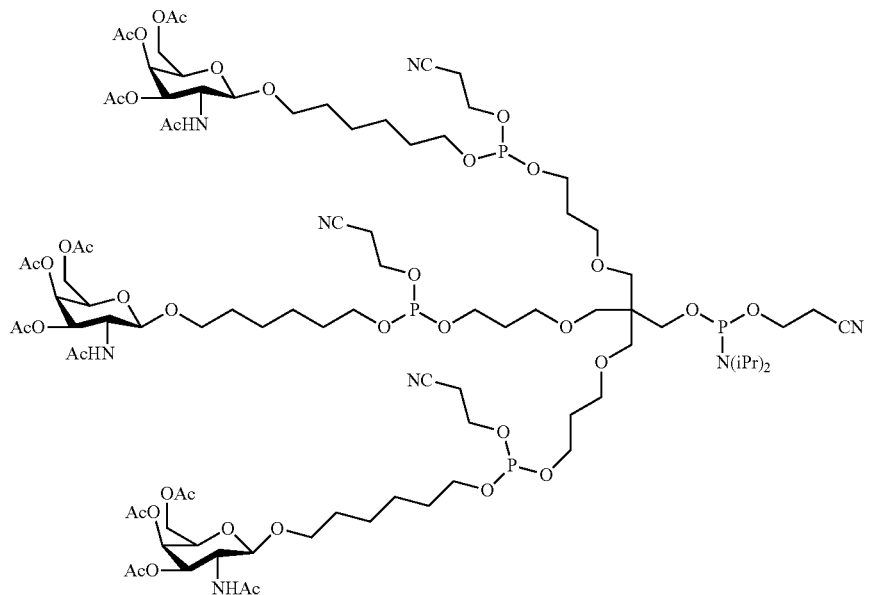
79
Example 36
Preparation of Compound 79a
Compound 77 is prepared as per the procedures illustrated in Example 35.
-continued
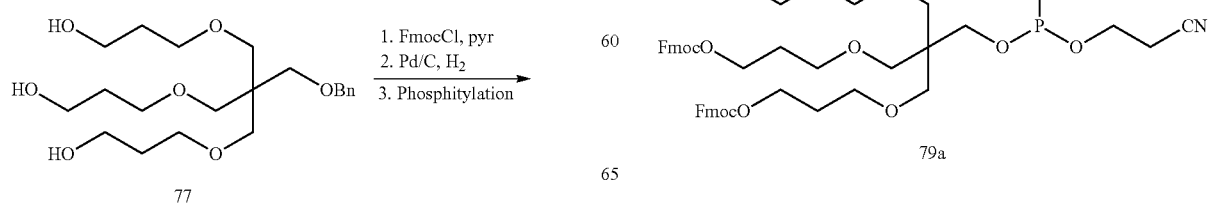

Example 37
General Method for the Preparation of Conjugated Oligomeric Compound 82 Comprising a Phosphodiester Linked GalNAc₃-2 Conjugate at 5' Terminus Via Solid Support (Method I)
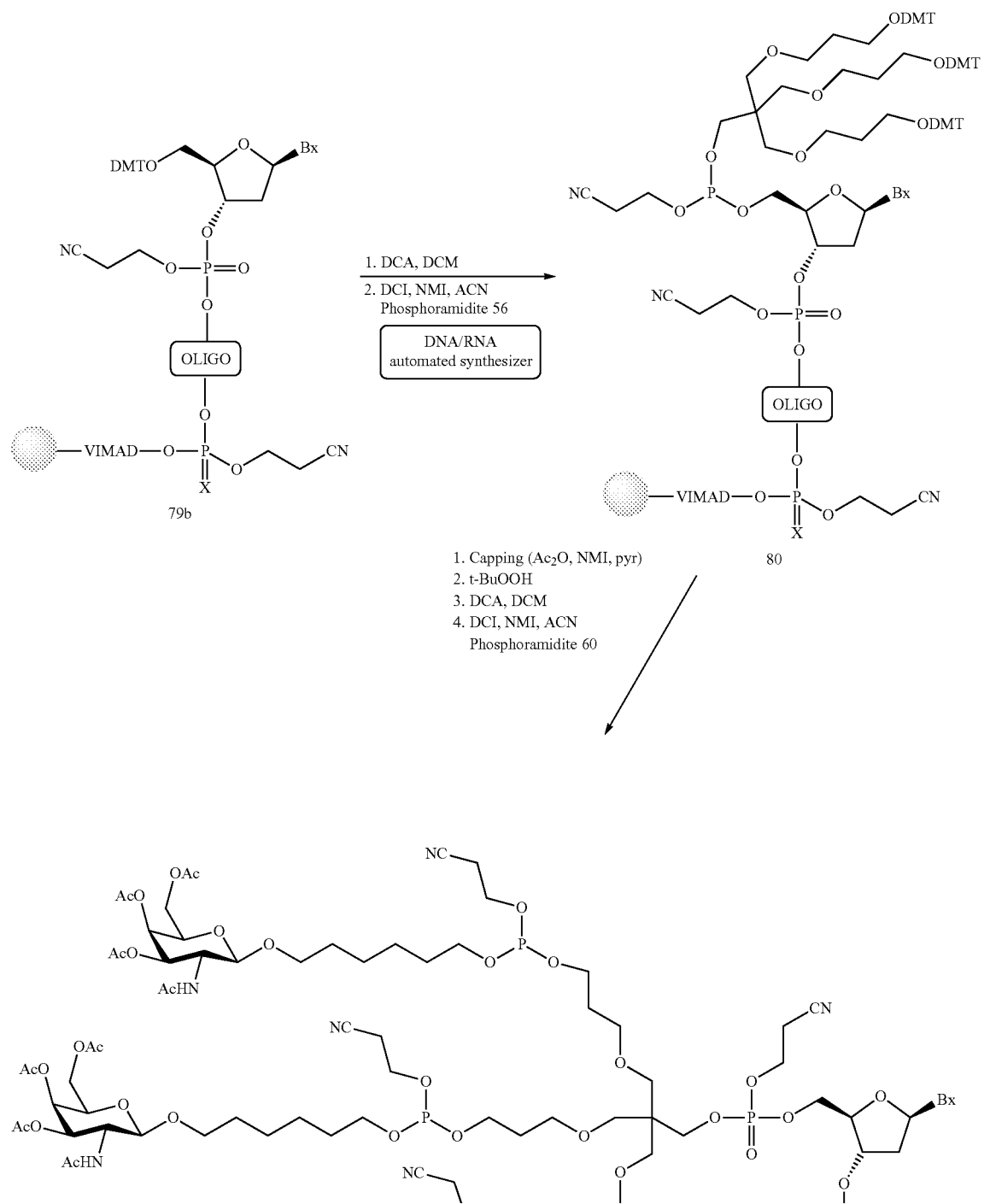

243 244
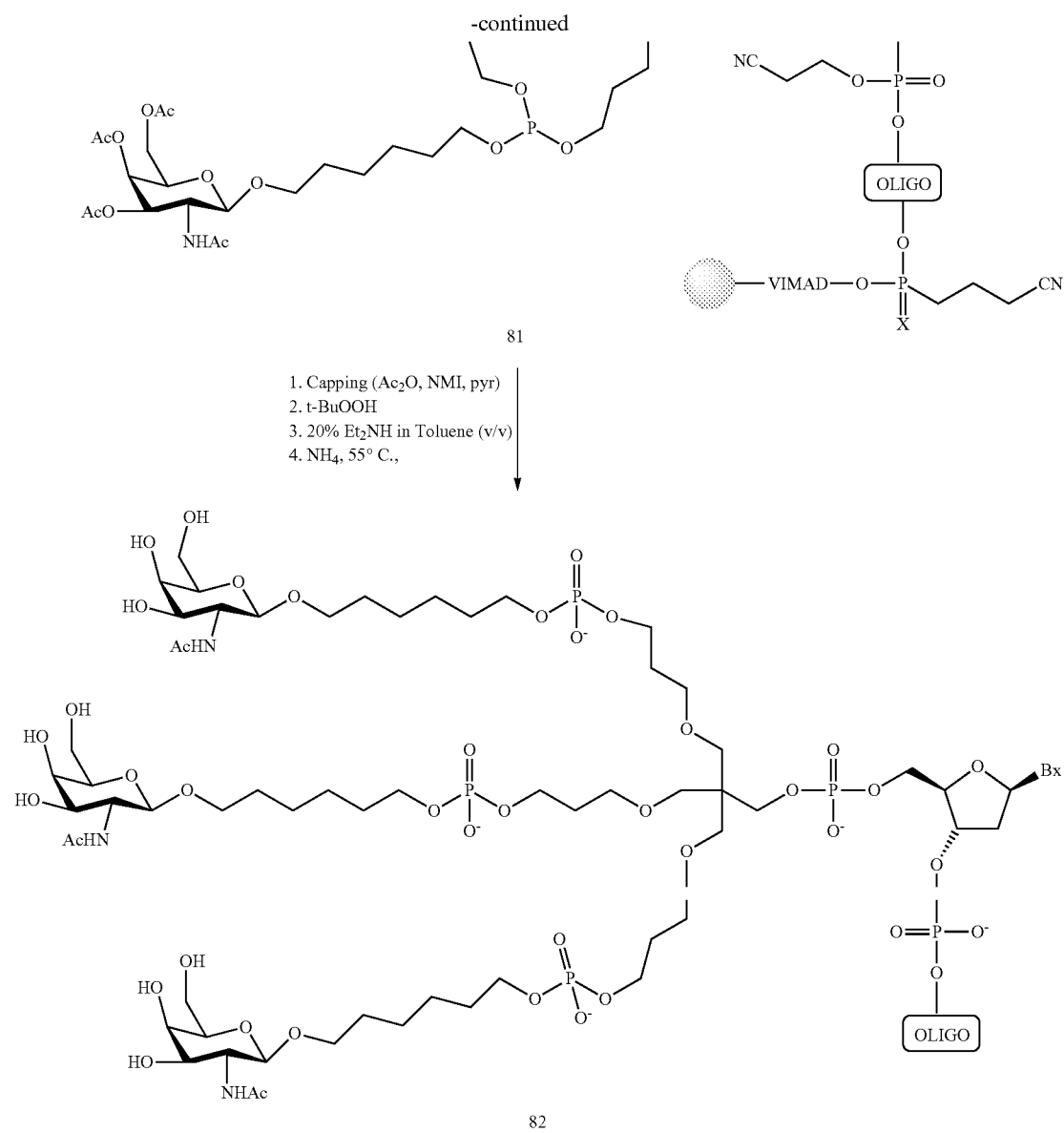
X = S⁻ or O⁻
Bx = Heterocylic base
wherein GalNAc₃-2 has the structure:
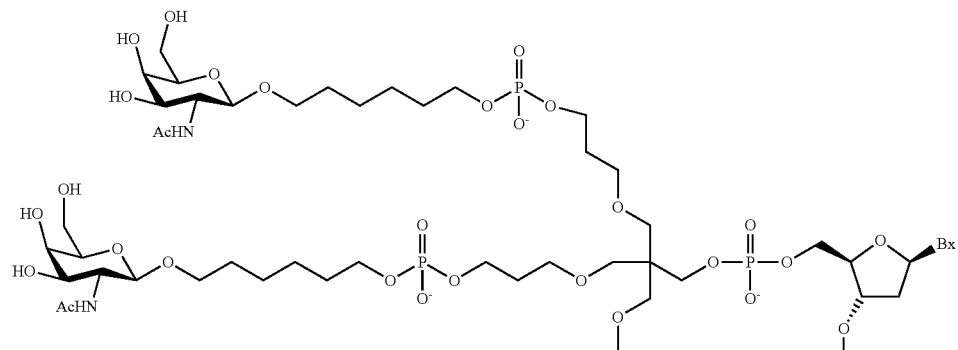

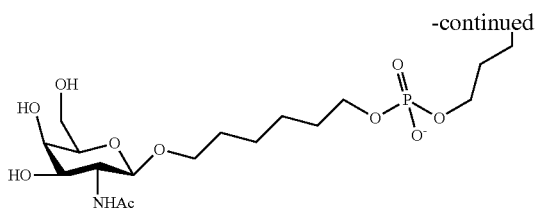

The GalNAc₃ cluster portion of the conjugate group GalNAc₃-2 (GalNAc₃-2$_a$) can be combined with any cleavable moiety to provide a variety of conjugate groups. Wherein GalNAc₃-2$_a$ has the formula:

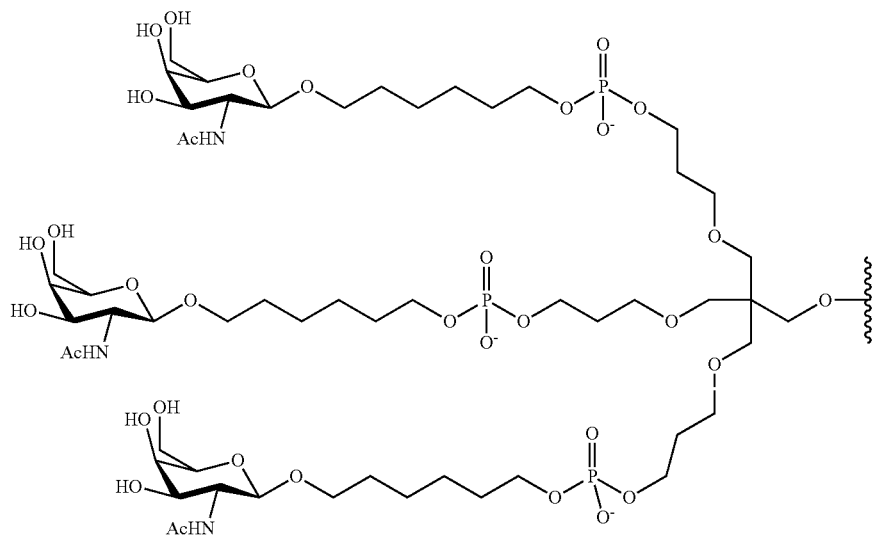

The VIMAD-bound oligomeric compound 79b was prepared using standard procedures for automated DNA/RNA synthesis (see Dupouy et al., *Angew. Chem. Int. Ed.*, 2006, 45, 3623-3627). The phosphoramidite Compounds 56 and 60 were prepared as per the procedures illustrated in Examples 27 and 28, respectively. The phosphoramidites illustrated are meant to be representative and not intended to be limiting as other phosphoramidite building blocks including but not limited those presented in the specification herein can be used to prepare an oligomeric compound having a phosphodiester linked conjugate group at the 5' terminus. The order and quantity of phosphoramidites added to the solid support can be adjusted to prepare the oligomeric compounds as described herein having any predetermined sequence and composition.

Example 38

Alternative Method for the Preparation of Oligomeric Compound 82 Comprising a Phosphodiester Linked GalNAc₃-2 Conjugate at 5' Terminus (Method II)

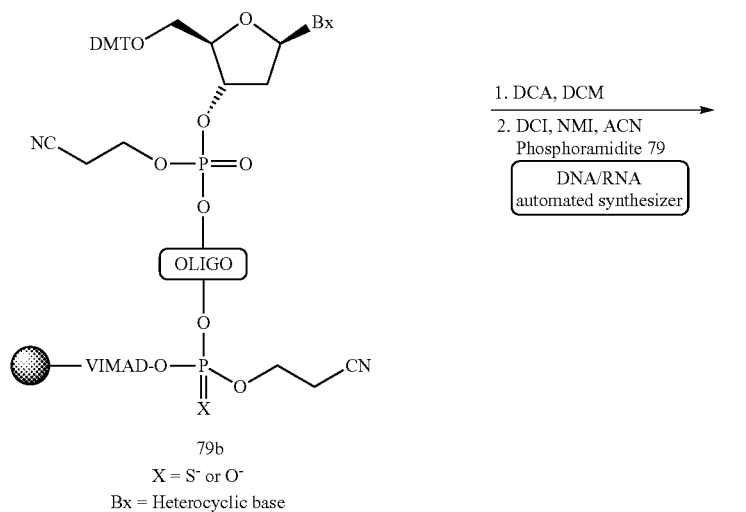

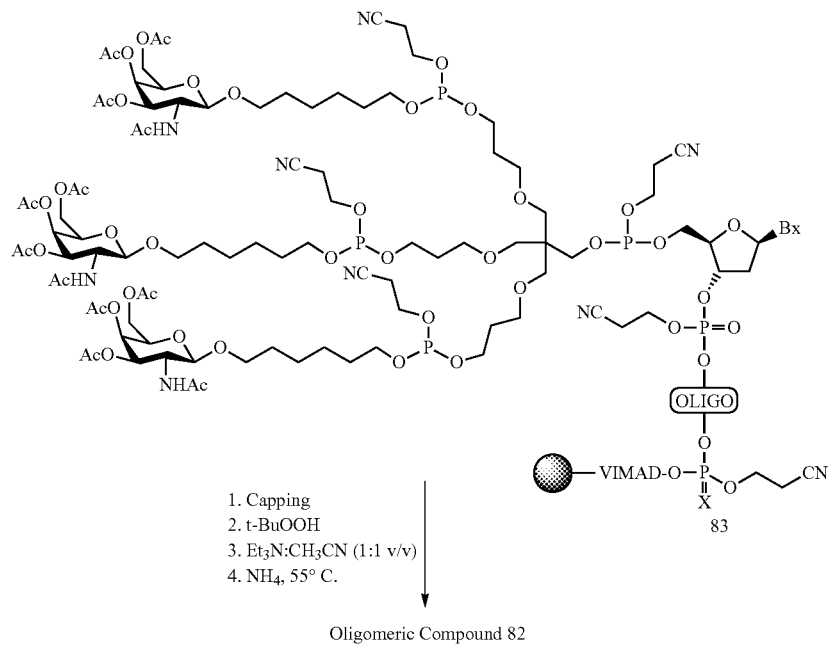

Oligomeric Compound 82

The VIMAD-bound oligomeric compound 79b was prepared using standard procedures for automated DNA/RNA synthesis (see Dupouy et al., *Angew. Chem. Int. Ed.,* 2006, 45, 3623-3627). The GalNAc₃-2 cluster phosphoramidite, Compound 79 was prepared as per the procedures illustrated in Example 35. This alternative method allows a one-step installation of the phosphodiester linked GalNAc₃-2 conjugate to the oligomeric compound at the final step of the synthesis. The phosphoramidites illustrated are meant to be representative and not intended to be limiting, as other phosphoramidite building blocks including but not limited to those presented in the specification herein can be used to prepare oligomeric compounds having a phosphodiester conjugate at the 5' terminus. The order and quantity of phosphoramidites added to the solid support can be adjusted to prepare the oligomeric compounds as described herein having any predetermined sequence and composition.

Example 39
General Method for the Preparation of Oligomeric Compound 83h Comprising a GalNAc₃-3 Conjugate at the 5' Terminus (GalNAc₃-1 Modified for 5' End Attachment) Via Solid Support
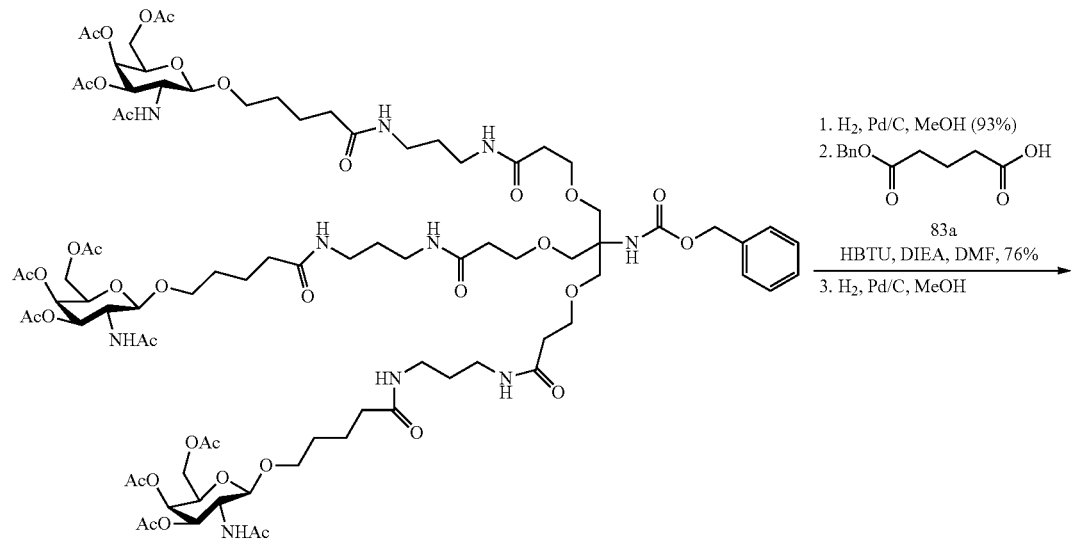
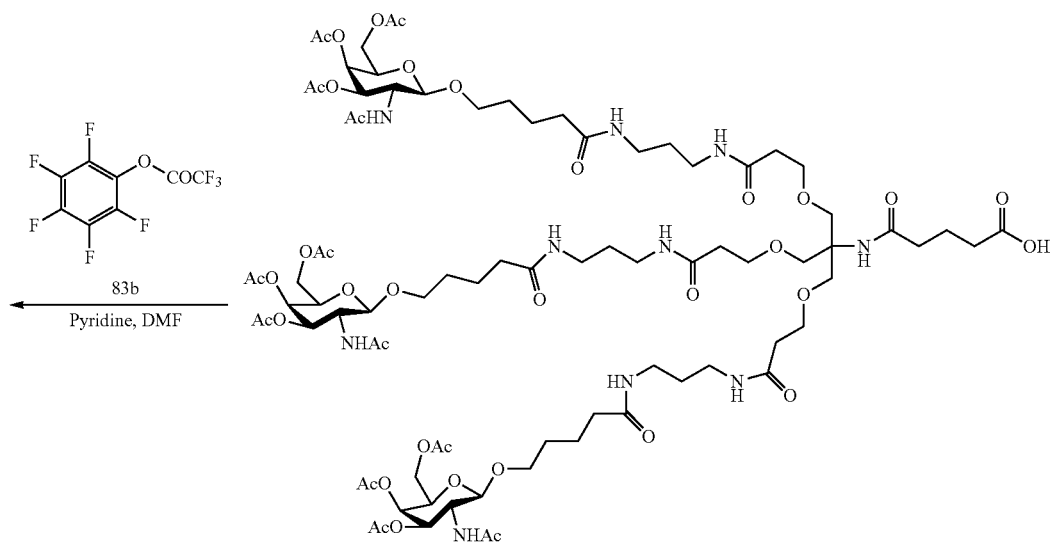

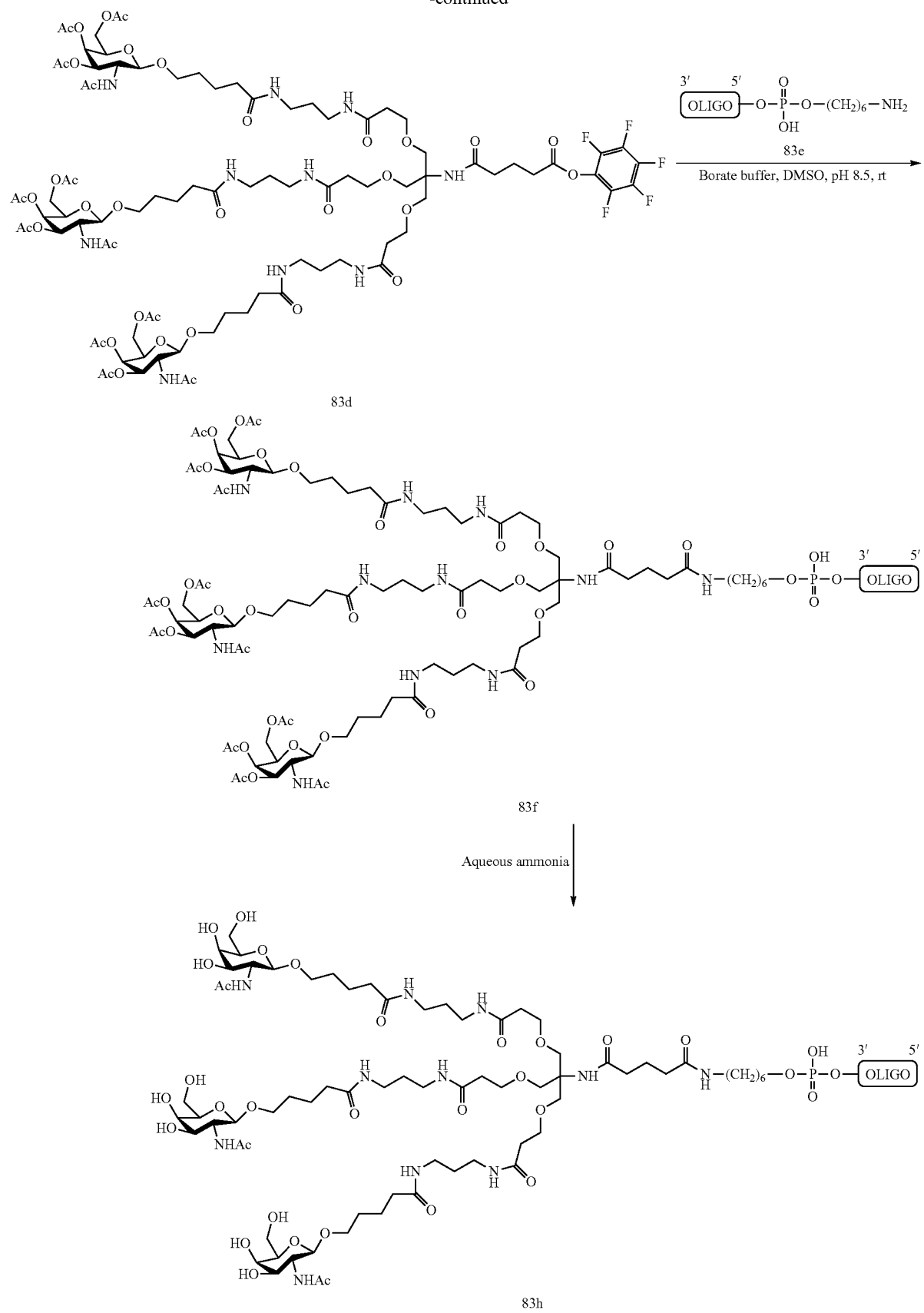

Compound 18 was prepared as per the procedures illustrated in Example 4. Compounds 83a and 83b are commercially available. Oligomeric Compound 83e comprising a phosphodiester linked hexylamine was prepared using standard oligonucleotide synthesis procedures. Treatment of the protected oligomeric compound with aqueous ammonia provided the 5'-GalNAc$_3$-3 conjugated oligomeric compound (83h).

Wherein GalNAc$_3$-3 has the structure:

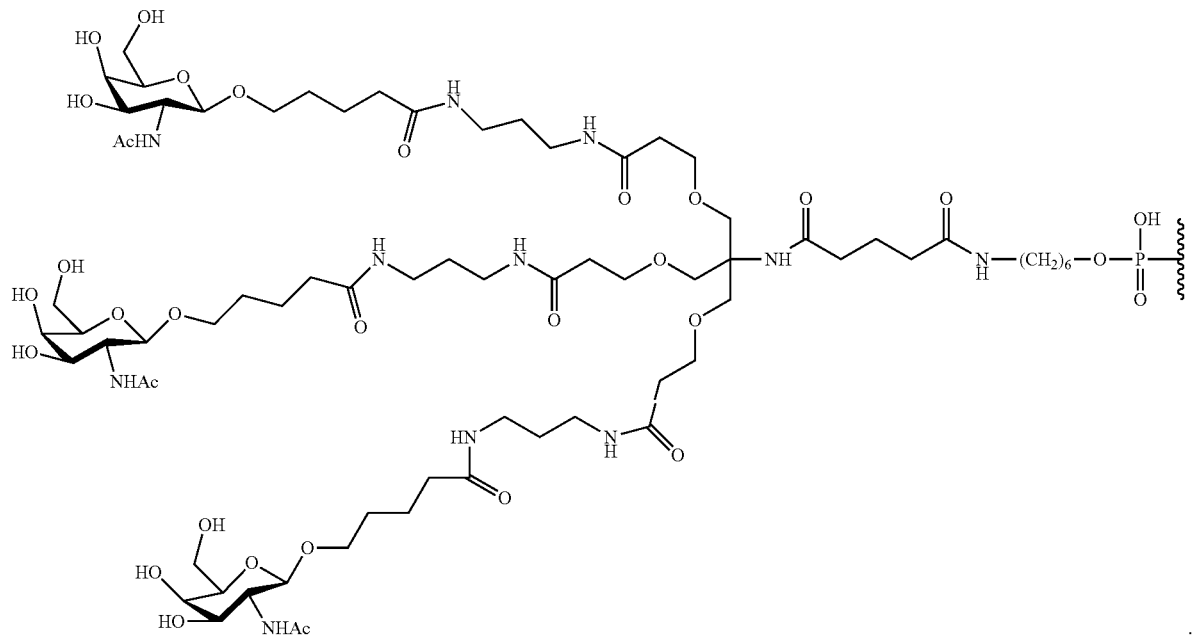

The GalNAc$_3$ cluster portion of the conjugate group GalNAc$_3$-3 (GalNAc$_3$-3$_a$) can be combined with any cleavable moiety to provide a variety of conjugate groups. Wherein GalNAc$_3$-3$_a$ has the formula:

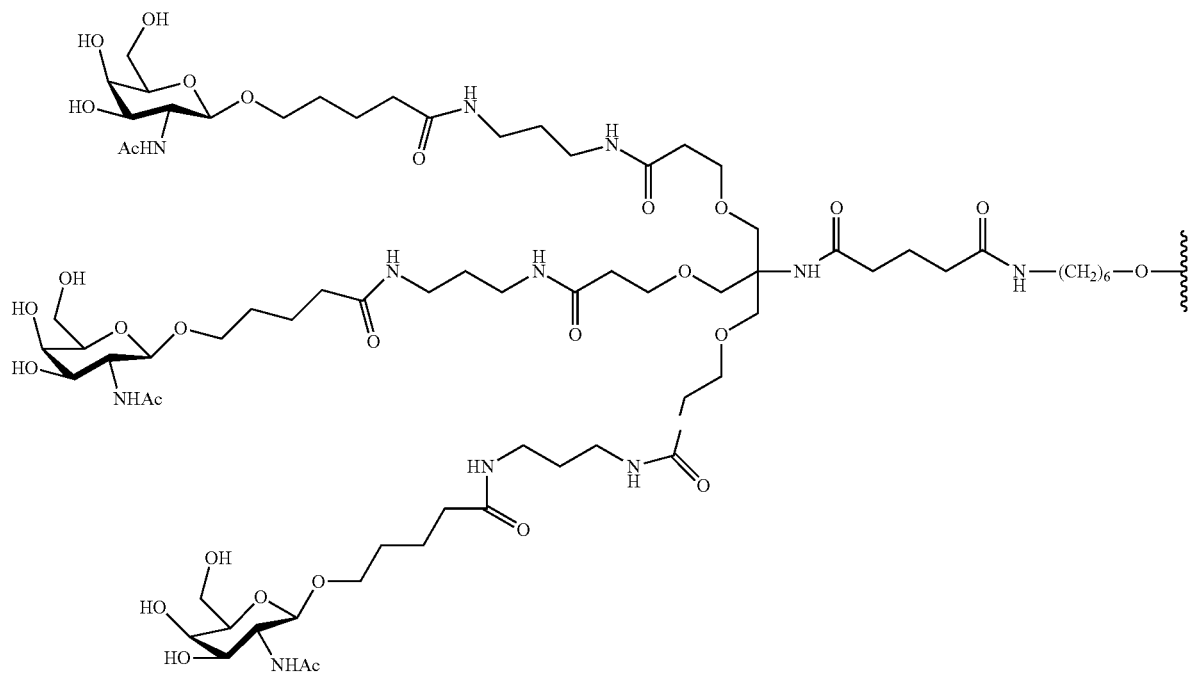

Example 40
General Method for the Preparation of Oligomeric Compound 89 Comprising a Phosphodiester Linked GalNAc₃-4 Conjugate at the 3' Terminus Via Solid Support
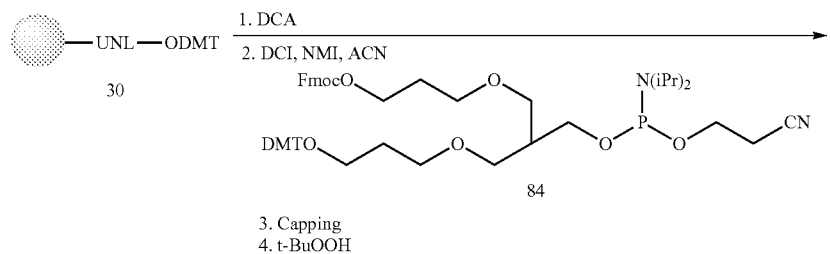
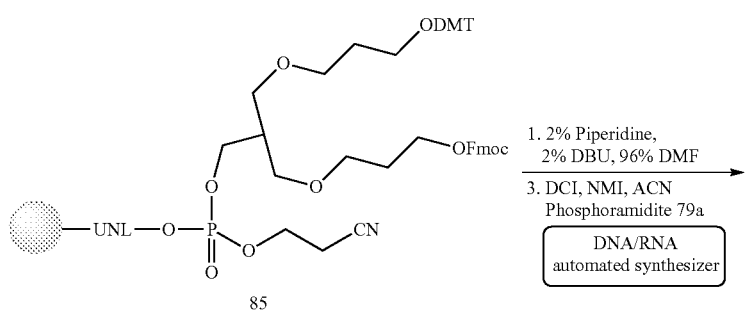
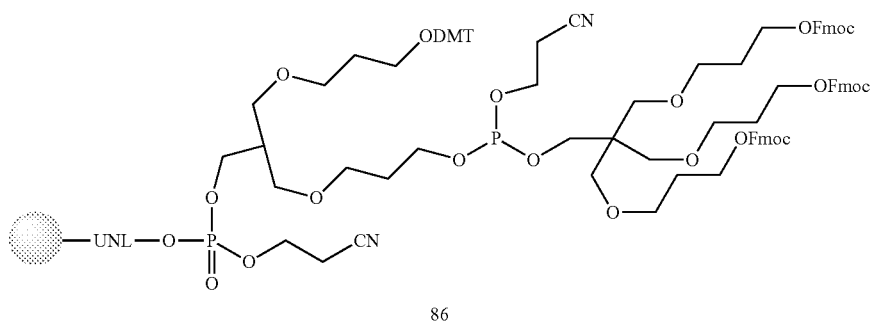

-continued
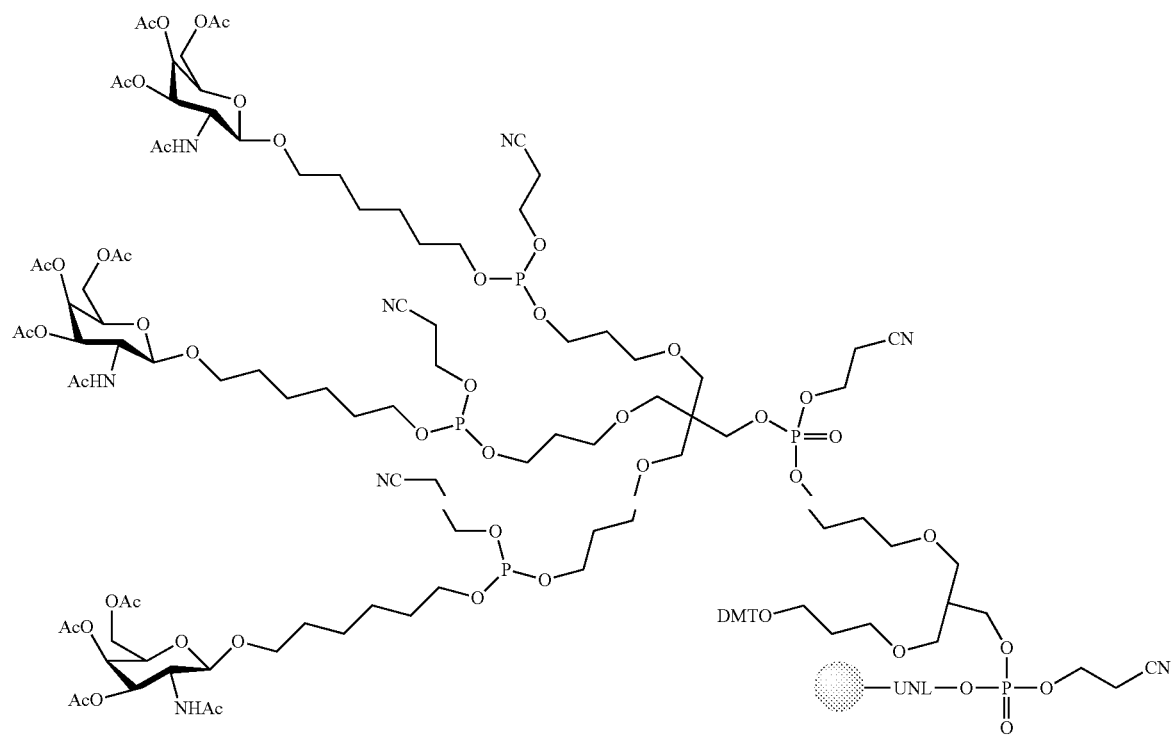
87
1. t-BuOOH
2. DCA
3. Oligo synthesis (DNA/RNA automated synthesizer)
4. Capping
5. Oxidation
6. Et$_3$N:CH$_3$CN (1:1, v/v)
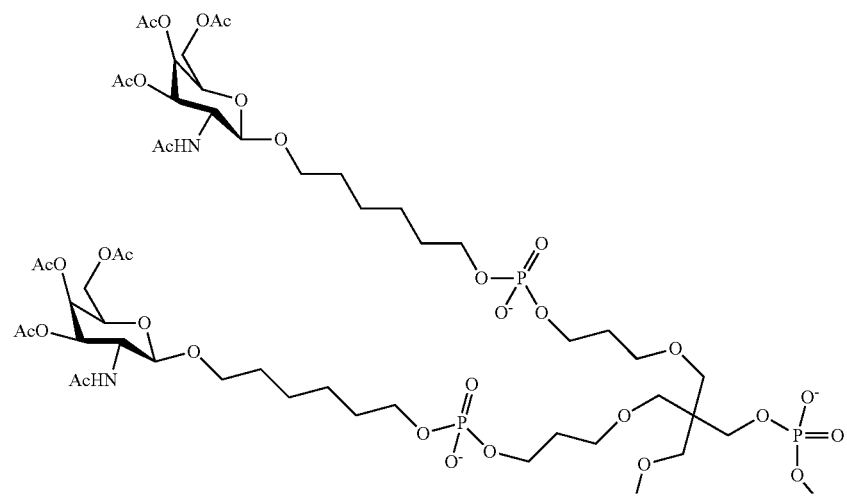

259 260
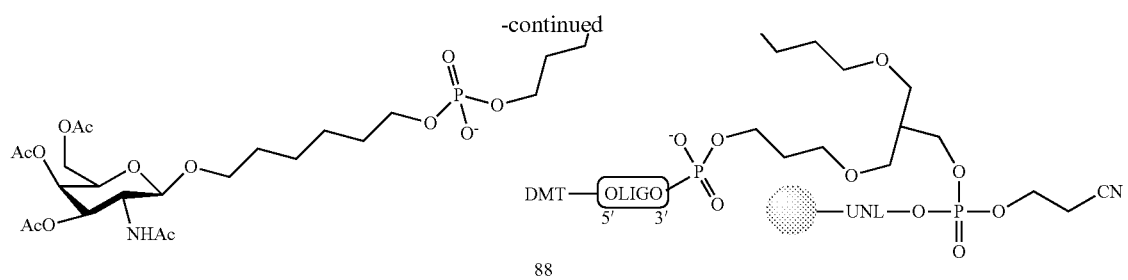
88
NH$_4$, 55° C.
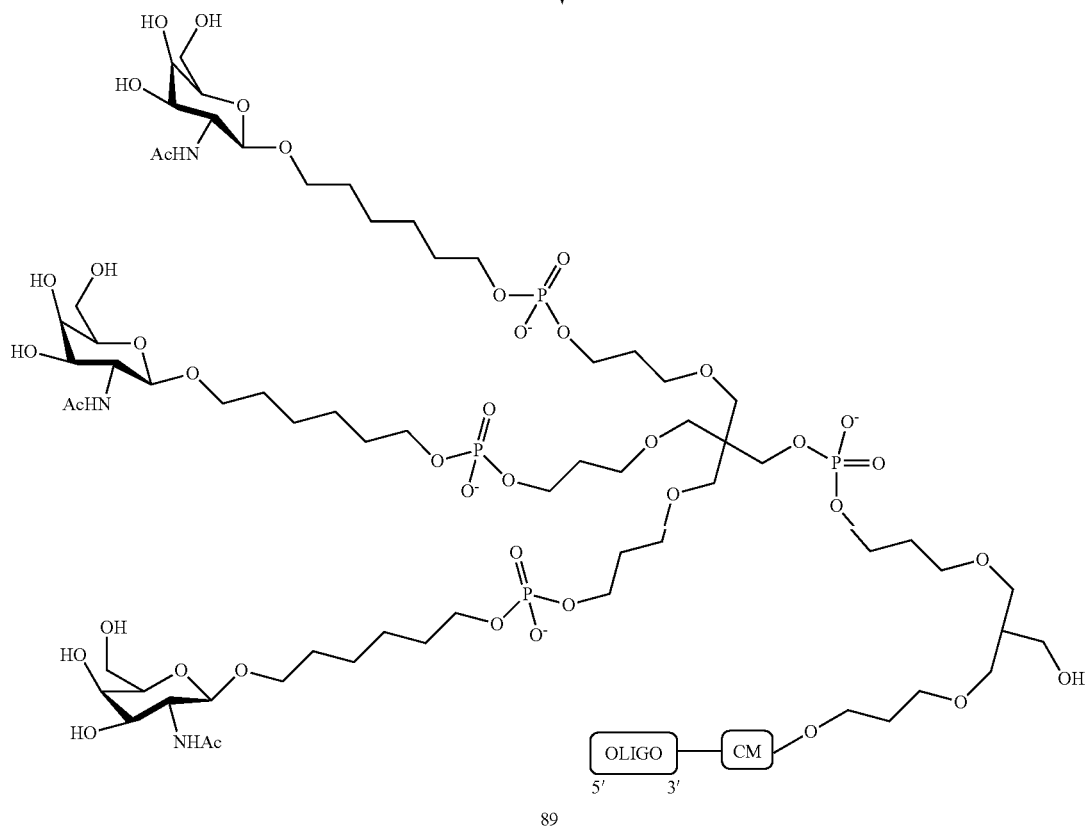
89
Wherein GalNAc$_3$-4 has the structure:
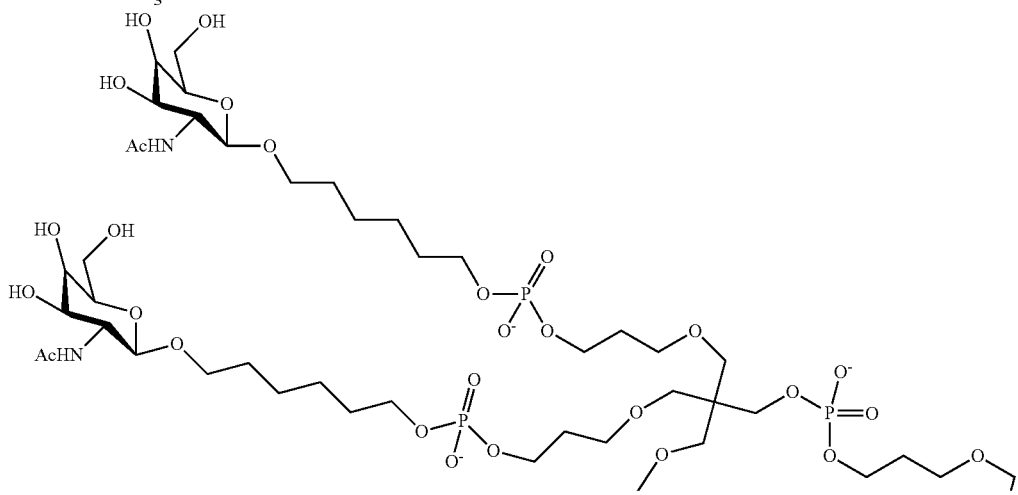

261

-continued

262

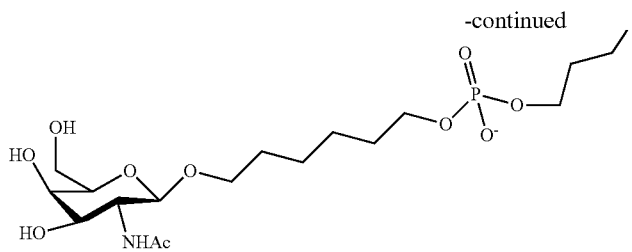

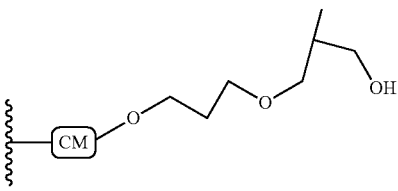

Wherein CM is a cleavable moiety. In certain embodiments, cleavable moiety is:

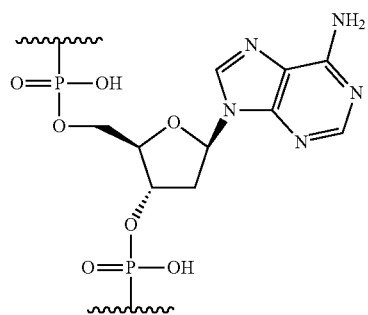

The GalNAc$_3$ cluster portion of the conjugate group GalNAc$_3$-4 (GalNAc$_3$-4$_a$) can be combined with any cleavable moiety to provide a variety of conjugate groups. Wherein GalNAc$_3$-4$_a$ has the formula:

The protected Unylinker functionalized solid support Compound 30 is commercially available. Compound 84 is prepared using procedures similar to those reported in the literature (see Shchepinov et al., *Nucleic Acids Research*, 1997, 25(22), 4447-4454; Shchepinov et al., *Nucleic Acids Research*, 1999, 27, 3035-3041; and Hornet et al., *Nucleic Acids Research*, 1997, 25, 4842-4849).

The phosphoramidite building blocks, Compounds 60 and 79a are prepared as per the procedures illustrated in Examples 28 and 36. The phosphoramidites illustrated are meant to be representative and not intended to be limiting as other phosphoramidite building blocks can be used to prepare an oligomeric compound having a phosphodiester linked conjugate at the 3' terminus with a predetermined sequence and composition. The order and quantity of phosphoramidites added to the solid support can be adjusted to prepare the oligomeric compounds as described herein having any predetermined sequence and composition.

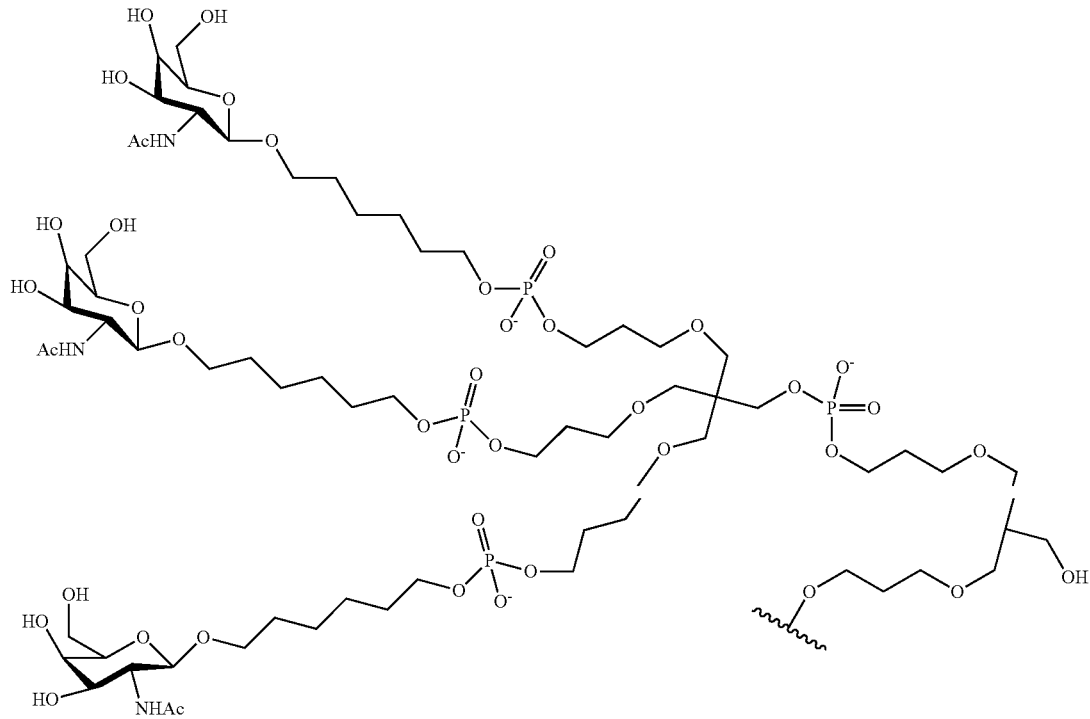

Example 41

General Method for the Preparation of ASOs Comprising a Phosphodiester Linked GalNAc$_3$-2 (See Example 37, Bx is Adenine) Conjugate at the 5' Position Via Solid Phase Techniques (Preparation of ISIS 661134)

Unless otherwise stated, all reagents and solutions used for the synthesis of oligomeric compounds are purchased from commercial sources. Standard phosphoramidite building blocks and solid support are used for incorporation nucleoside residues which include for example T, A, G, and $^m$C residues. Phosphoramidite compounds 56 and 60 were used to synthesize the phosphodiester linked GalNAc$_3$-2 conjugate at the 5' terminus. A 0.1 M solution of phosphoramidite in anhydrous acetonitrile was used for β-D-2'-deoxyribonucleoside and 2'-MOE.

The ASO syntheses were performed on ABI 394 synthesizer (1-2 μmol scale) or on GE Healthcare Bioscience ÄKTA oligopilot synthesizer (40-200 μmol scale) by the phosphoramidite coupling method on VIMAD solid support (110 μmol/g, Guzaev et al., 2003) packed in the column. For the coupling step, the phosphoramidites were delivered at a 4 fold excess over the initial loading of the solid support and phosphoramidite coupling was carried out for 10 min. All other steps followed standard protocols supplied by the manufacturer. A solution of 6% dichloroacetic acid in toluene was used for removing the dimethoxytrityl (DMT) groups from 5'-hydroxyl groups of the nucleotide. 4,5-Dicyanoimidazole (0.7 M) in anhydrous CH$_3$CN was used as activator during the coupling step. Phosphorothioate linkages were introduced by sulfurization with 0.1 M solution of xanthane hydride in 1:1 pyridine/CH$_3$CN for a contact time of 3 minutes. A solution of 20% tert-butylhydroperoxide in CH$_3$CN containing 6% water was used as an oxidizing agent to provide phosphodiester internucleoside linkages with a contact time of 12 minutes.

After the desired sequence was assembled, the cyanoethyl phosphate protecting groups were deprotected using a 20% diethylamine in toluene (v/v) with a contact time of 45 minutes. The solid-support bound ASOs were suspended in aqueous ammonia (28-30 wt %) and heated at 55° C. for 6 h.

The unbound ASOs were then filtered and the ammonia was boiled off. The residue was purified by high pressure liquid chromatography on a strong anion exchange column (GE Healthcare Bioscience, Source 30Q, 30 μm, 2.54×8 cm, A=100 mM ammonium acetate in 30% aqueous CH$_3$CN, B=1.5 M NaBr in A, 0-40% of B in 60 min, flow 14 mL min-1, λ=260 nm). The residue was desalted by HPLC on a reverse phase column to yield the desired ASOs in an isolated yield of 15-30% based on the initial loading on the solid support. The ASOs were characterized by ion-pair-HPLC coupled MS analysis with Agilent 1100 MSD system.

TABLE 34

ASO comprising a phosphodiester linked GalNAc$_3$-2 conjugate at the 5' position targeting SRB-1

| ISIS No. | Sequence (5' to 3') | CalCd Mass | Observed Mass | SEQ ID No. |
|---|---|---|---|---|
| 661134 | GalNAc$_3$-2$_a$-$_o$.A$_{do}$T$_{ks}$$^m$C$_{ks}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{ks}$$^m$C$_k$ | 6482.2 | 6481.6 | 2302 |

Subscripts: "e" indicates 2'-MOE modified nucleoside; "d" indicates β-D-2'-deoxyribonucleoside; "k" indicates 6'-(S)—CH$_3$ bicyclic nucleoside (e.g. cEt); "s" indicates phosphorothioate internucleoside linkages (PS); "o" indicates phosphodiester internucleoside linkages (PO); and "o'" indicates —O—P(=O)(OH)—. Superscript "m" indicates 5-methylcytosines. The structure of GalNAc$_3$-2$_a$ is shown in Example 37.

Example 42

General Method for the Preparation of ASOs Comprising a GalNAc$_3$-3 Conjugate at the 5' Position Via Solid Phase Techniques (Preparation of ISIS 661166)

The synthesis for ISIS 661166 was performed using similar procedures as illustrated in Examples 39 and 41.

ISIS 661166 is a 5-10-5 MOE gapmer, wherein the 5' position comprises a GalNAc$_3$-3 conjugate. The ASO was characterized by ion-pair-HPLC coupled MS analysis with Agilent 1100 MSD system.

TABLE 34a

ASO comprising a GalNAc$_3$-3 conjugate at the 5' position via a hexylamino ester linkage targeting Malat-1

| ISIS No. | Sequence (5' to 3') | Conjugate | Calcd Mass | Observed Mass | SEQ ID No. |
|---|---|---|---|---|---|
| 661166 | 5'-GalNAc$_3$-3$_a$-$_o$.$^m$C$_{es}$G$_{es}$G$_{es}$T$_{es}$G$_{es}$ $^m$C$_{ds}$A$_{ds}$A$_{ds}$G$_{ds}$G$_{ds}$$^m$C$_{ds}$T$_{ds}$T$_{ds}$A$_{ds}$G$_{ds}$ G$_{es}$A$_{es}$A$_{es}$T$_{es}$T$_e$ | 5'-GalNAc$_3$-3 | 8992.16 | 8990.51 | 2303 |

Subscripts: "e" indicates 2'-MOE modified nucleoside; "d" indicates β-D-2'-deoxyribonucleoside; "s" indicates phosphorothioate internucleoside linkages (PS); "o" indicates phosphodiester internucleoside linkages (PO); and "o'" indicates —O—P(═O)(OH)—. Superscript "m" indicates 5-methylcytosines. The structure of "5'-GalNAc$_3$-3a" is shown in Example 39.

Example 43

Dose-Dependent Study of Phosphodiester Linked GalNAc$_3$-2 (See Examples 37 and 41, Bx is Adenine) at the 5' Terminus Targeting SRB-1 In Vivo ISIS 661134 (see Example 41) comprising a phosphodiester linked GalNAc$_3$-2 conjugate at the 5' terminus was tested in a dose-dependent study for antisense inhibition of SRB-1 in mice. Unconjugated ISIS 440762 and 651900 (GalNAc$_3$-1 conjugate at 3' terminus, see Example 9) were included in the study for comparison and are described previously in Table 17.

Treatment

Six week old male Balb/c mice (Jackson Laboratory, Bar Harbor, Me.) were injected subcutaneously once at the dosage shown below with ISIS 440762, 651900, 661134 or with PBS treated control. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS". The ED$_{50}$s were measured using similar methods as described previously and are presented below.

As illustrated in Table 35, treatment with antisense oligonucleotides lowered SRB-1 mRNA levels in a dose-dependent manner Indeed, the antisense oligonucleotides comprising the phosphodiester linked GalNAc$_3$-2 conjugate at the 5' terminus (ISIS 661134) or the GalNAc$_3$-1 conjugate linked at the 3' terminus (ISIS 651900) showed substantial improvement in potency compared to the unconjugated antisense oligonucleotide (ISIS 440762). Further, ISIS 661134, which comprises the phosphodiester linked GalNAc$_3$-2 conjugate at the 5' terminus was equipotent compared to ISIS 651900, which comprises the GalNAc$_3$-1 conjugate at the 3' terminus.

TABLE 35

ASOs containing GalNAc$_3$-1 or GalNAc$_3$-2 targeting SRB-1

| ISIS No. | Dosage (mg/kg) | SRB-1 mRNA levels (% PBS) | ED$_{50}$ (mg/kg) | Conjugate | SEQ ID No. |
|---|---|---|---|---|---|
| PBS | 0 | 100 | — | — | |
| 440762 | 0.2 | 116 | 2.58 | No conjugate | 2298 |
| | 0.7 | 91 | | | |
| | 2 | 69 | | | |
| | 7 | 22 | | | |
| | 20 | 5 | | | |
| 651900 | 0.07 | 95 | 0.26 | 3' GalNAc$_3$-1 | 2299 |
| | 0.2 | 77 | | | |
| | 0.7 | 28 | | | |
| | 2 | 11 | | | |
| | 7 | 8 | | | |
| 661134 | 0.07 | 107 | 0.25 | 5' GalNAc$_3$-2 | 2302 |
| | 0.2 | 86 | | | |
| | 0.7 | 28 | | | |
| | 2 | 10 | | | |
| | 7 | 6 | | | |

Structures for 3' GalNAc$_3$-1 and 5' GalNAc$_3$-2 were described previously in Examples 9 and 37.

Pharmacokinetics Analysis (PK)

The PK of the ASOs from the high dose group (7 mg/kg) was examined and evaluated in the same manner as illustrated in Example 20. Liver sample was minced and extracted using standard protocols. The full length metabolites of 661134 (5' GalNAc$_3$-2) and ISIS 651900 (3' GalNAc$_3$-1) were identified and their masses were confirmed by high resolution mass spectrometry analysis. The results showed that the major metabolite detected for the ASO comprising a phosphodiester linked GalNAc$_3$-2 conjugate at the 5' terminus (ISIS 661134) was ISIS 440762 (data not shown). No additional metabolites, at a detectable level, were observed. Unlike its counterpart, additional metabolites similar to those reported previously in Table 23a were observed for the ASO having the GalNAc$_3$-1 conjugate at the 3' terminus (ISIS 651900). These results suggest that having the phosphodiester linked GalNAc$_3$-1 or GalNAc$_3$-2 conjugate may improve the PK profile of ASOs without compromising their potency.

Example 44

Effect of PO/PS Linkages on Antisense Inhibition of ASOs Comprising GalNAc$_3$-1 Conjugate (See Example 9) at the 3' Terminus Targeting SRB-1

ISIS 655861 and 655862 comprising a GalNAc$_3$-1 conjugate at the 3' terminus each targeting SRB-1 were tested in a single administration study for their ability to inhibit SRB-1 in mice. The parent unconjugated compound, ISIS 353382 was included in the study for comparison.

The ASOs are 5-10-5 MOE gapmers, wherein the gap region comprises ten 2'-deoxyribonucleosides and each wing region comprises five 2'-MOE modified nucleosides. The ASOs were prepared using similar methods as illustrated previously in Example 19 and are described Table 36, below.

TABLE 36

Modified ASOs comprising GalNAc$_3$-1 conjugate at the 3' terminus targeting SRB-1

| ISIS No. | Sequence (5' to 3') | Chemistry | SEQ ID No. |
|---|---|---|---|
| 353382 (parent) | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | Full PS no conjugate | 2304 |
| 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$'-GalNAc$_3$-1$_a$ | Full PS with GalNAc$_3$-1 conjugate | 2305 |
| 655862 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_{eo}$A$_{do}$'-GalNAc$_3$-1$_a$ | Mixed PS/PO with GalNAc$_3$-1 conjugate | 2305 |

Subscripts: "e" indicates 2'-MOE modified nucleoside; "d" indicates β-D-2'-deoxyribonucleoside; "s" indicates phosphorothioate internucleoside linkages (PS); "o" indicates phosphodiester internucleoside linkages (PO); and "o'" indicates —O—P(=O)(OH)—. Superscript "m" indicates 5-methylcytosines. The structure of "GalNAc$_3$-1" is shown in Example 9.

Treatment

Six week old male Balb/c mice (Jackson Laboratory, Bar Harbor, Me.) were injected subcutaneously once at the dosage shown below with ISIS 353382, 655861, 655862 or with PBS treated control. Each treatment group consisted of 4 animals. Prior to the treatment as well as after the last dose, blood was drawn from each mouse and plasma samples were analyzed. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS". The ED$_{50}$s were measured using similar methods as described previously and are reported below.

As illustrated in Table 37, treatment with antisense oligonucleotides lowered SRB-1 mRNA levels in a dose-dependent manner compared to PBS treated control. Indeed, the antisense oligonucleotides comprising the GalNAc$_3$-1 conjugate at the 3' terminus (ISIS 655861 and 655862) showed substantial improvement in potency comparing to the unconjugated antisense oligonucleotide (ISIS 353382). Further, ISIS 655862 with mixed PS/PO linkages showed an improvement in potency relative to full PS (ISIS 655861).

TABLE 37

Effect of PO/PS linkages on antisense inhibition of ASOs comprising GalNAc$_3$-1 conjugate at 3' terminus targeting SRB-1

| ISIS No. | Dosage (mg/kg) | SRB-1 mRNA levels (% PBS) | ED$_{50}$ (mg/kg) | Chemistry | SEQ ID No. |
|---|---|---|---|---|---|
| PBS | 0 | 100 | — | — | |
| 353382 (parent) | 3 | 76.65 | 10.4 | Full PS without conjugate | 2304 |
| | 10 | 52.40 | | | |
| | 30 | 24.95 | | | |
| 655861 | 0.5 | 81.22 | 2.2 | Full PS with GalNAc$_3$-1 conjugate | 2305 |
| | 1.5 | 63.51 | | | |
| | 5 | 24.61 | | | |
| | 15 | 14.80 | | | |

TABLE 37-continued

Effect of PO/PS linkages on antisense inhibition of ASOs comprising GalNAc$_3$-1 conjugate at 3' terminus targeting SRB-1

| ISIS No. | Dosage (mg/kg) | SRB-1 mRNA levels (% PBS) | ED$_{50}$ (mg/kg) | Chemistry | SEQ ID No. |
|---|---|---|---|---|---|
| 655862 | 0.5 | 69.57 | 1.3 | Mixed PS/PO with GalNAc$_3$-1 conjugate | 2305 |
| | 1.5 | 45.78 | | | |
| | 5 | 19.70 | | | |
| | 15 | 12.90 | | | |

Liver transaminase levels, alanine aminotransferase (ALT) and aspartate aminotransferase (AST), in serum were measured relative to saline injected mice using standard protocols. Organ weights were also evaluated. The results demonstrated that no elevation in transaminase levels (Table 38) or organ weights (data not shown) were observed in mice treated with ASOs compared to PBS control. Further, the ASO with mixed PS/PO linkages (ISIS 655862) showed similar transaminase levels compared to full PS (ISIS 655861).

TABLE 38

Effect of PO/PS linkages on transaminase levels of ASOs comprising GalNAc$_3$-1 conjugate at 3' terminus targeting SRB-1

| ISIS No. | Dosage (mg/kg) | ALT (U/L) | AST (U/L) | Chemistry | SEQ ID No. |
|---|---|---|---|---|---|
| PBS | 0 | 28.5 | 65 | — | |
| 353382 (parent) | 3 | 50.25 | 89 | Full PS without conjugate | 2304 |
| | 10 | 27.5 | 79.3 | | |
| | 30 | 27.3 | 97 | | |
| 655861 | 0.5 | 28 | 55.7 | Full PS with GalNAc$_3$-1 | 2305 |
| | 1.5 | 30 | 78 | | |
| | 5 | 29 | 63.5 | | |
| | 15 | 28.8 | 67.8 | | |
| 655862 | 0.5 | 50 | 75.5 | Mixed PS/PO with GalNAc$_3$-1 | 2305 |
| | 1.5 | 21.7 | 58.5 | | |
| | 5 | 29.3 | 69 | | |
| | 15 | 22 | 61 | | |

Example 45
Preparation of PFP Ester, Compound 110a
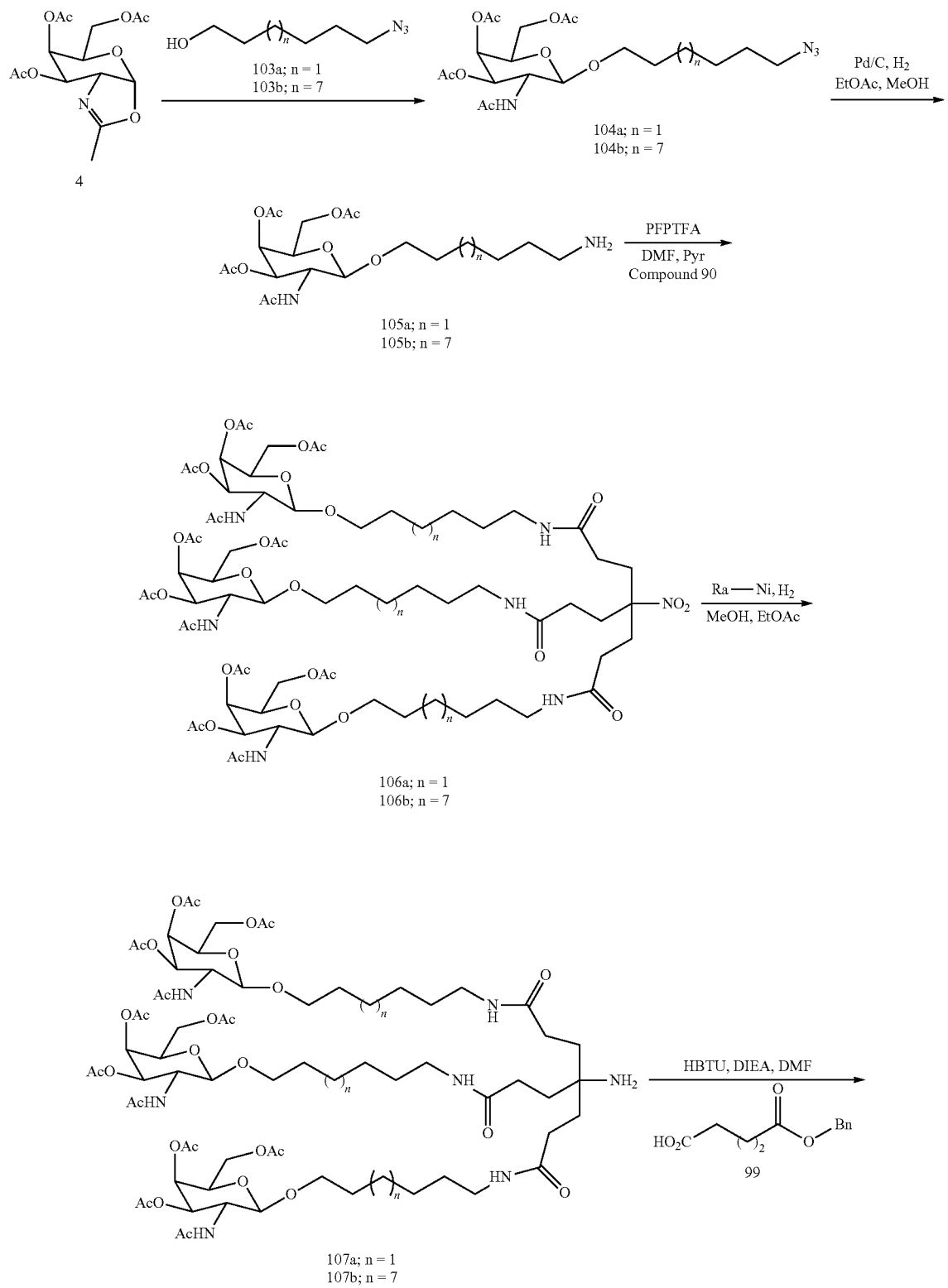

-continued
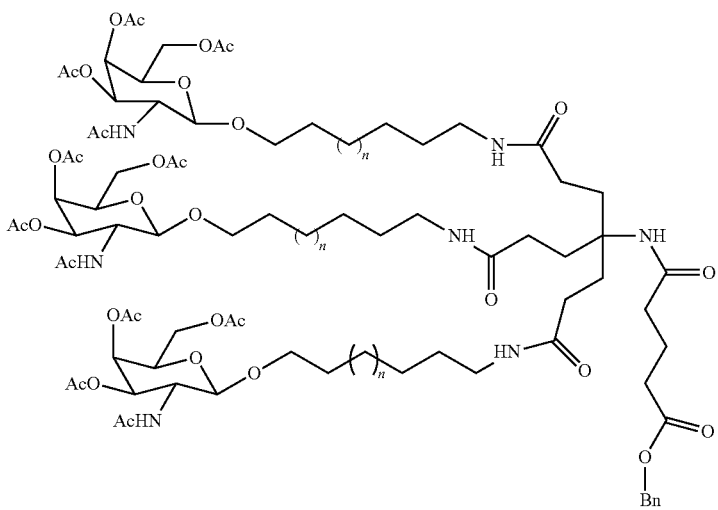
108a; n = 1
108b; n = 7
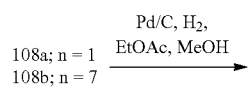
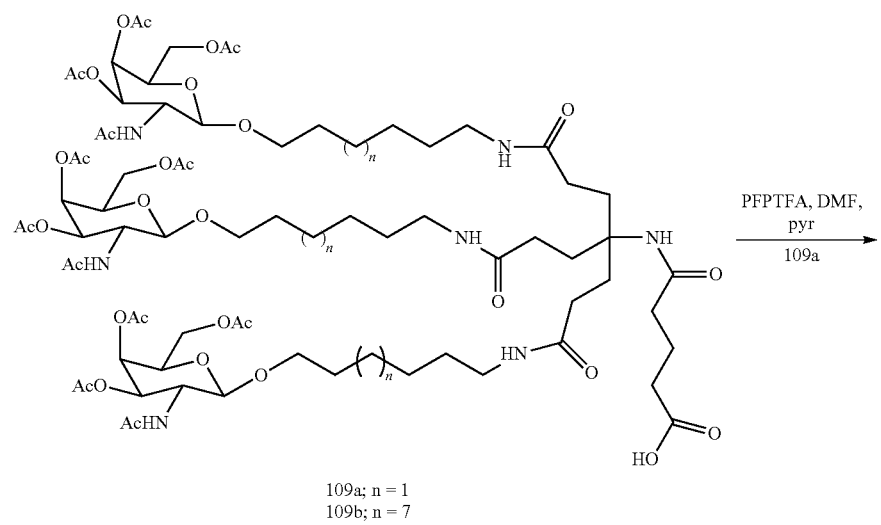
109a; n = 1
109b; n = 7

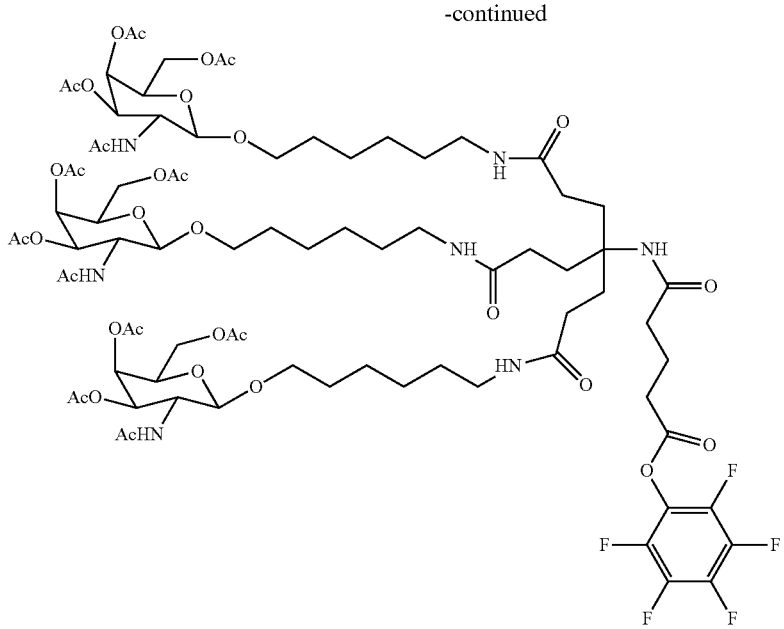

110a

Compound 4 (9.5 g, 28.8 mmoles) was treated with compound 103a or 103b (38 mmoles), individually, and TMSOTf (0.5 eq.) and molecular sieves in dichloromethane (200 mL), and stirred for 16 hours at room temperature. At that time, the organic layer was filtered thru celite, then washed with sodium bicarbonate, water and brine. The organic layer was then separated and dried over sodium sulfate, filtered and reduced under reduced pressure. The resultant oil was purified by silica gel chromatography (2%->10% methanol/dichloromethane) to give compounds 104a and 104b in >80% yield. LCMS and proton NMR was consistent with the structure.

Compounds 104a and 104b were treated to the same conditions as for compounds 100a-d (Example 47), to give compounds 105a and 105b in >90% yield. LCMS and proton NMR was consistent with the structure.

Compounds 105a and 105b were treated, individually, with compound 90 under the same conditions as for compounds 901a-d, to give compounds 106a (80%) and 106b (20%). LCMS and proton NMR was consistent with the structure.

Compounds 106a and 106b were treated to the same conditions as for compounds 96a-d (Example 47), to give 107a (60%) and 107b (20%). LCMS and proton NMR was consistent with the structure.

Compounds 107a and 107b were treated to the same conditions as for compounds 97a-d (Example 47), to give compounds 108a and 108b in 40-60% yield. LCMS and proton NMR was consistent with the structure.

Compounds 108a (60%) and 108b (40%) were treated to the same conditions as for compounds 100a-d (Example 47), to give compounds 109a and 109b in >80% yields. LCMS and proton NMR was consistent with the structure.

Compound 109a was treated to the same conditions as for compounds 101a-d (Example 47), to give Compound 110a in 30-60% yield. LCMS and proton NMR was consistent with the structure. Alternatively, Compound 110b can be prepared in a similar manner starting with Compound 109b.

Example 46

General Procedure for Conjugation with PFP Esters (Oligonucleotide 111); Preparation of ISIS 666881 (GalNAc$_3$-10)

A 5'-hexylamino modified oligonucleotide was synthesized and purified using standard solid-phase oligonucleotide procedures. The 5'-hexylamino modified oligonucleotide was dissolved in 0.1 M sodium tetraborate, pH 8.5 (200 µL) and 3 equivalents of a selected PFP esterified GalNAc$_3$ cluster dissolved in DMSO (50 µL) was added. If the PFP ester precipitated upon addition to the ASO solution DMSO was added until all PFP ester was in solution. The reaction was complete after about 16 h of mixing at room temperature. The resulting solution was diluted with water to 12 mL and then spun down at 3000 rpm in a spin filter with a mass cut off of 3000 Da. This process was repeated twice to remove small molecule impurities. The solution was then lyophilized to dryness and redissolved in concentrated aqueous ammonia and mixed at room temperature for 2.5 h followed by concentration in vacuo to remove most of the ammonia. The conjugated oligonucleotide was purified and desalted by RP-HPLC and lyophilized to provide the GalNAc$_3$ conjugated oligonucleotide.

110a 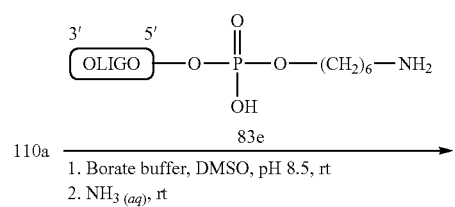

1. Borate buffer, DMSO, pH 8.5, rt
2. NH$_3$ $_{(aq)}$, rt

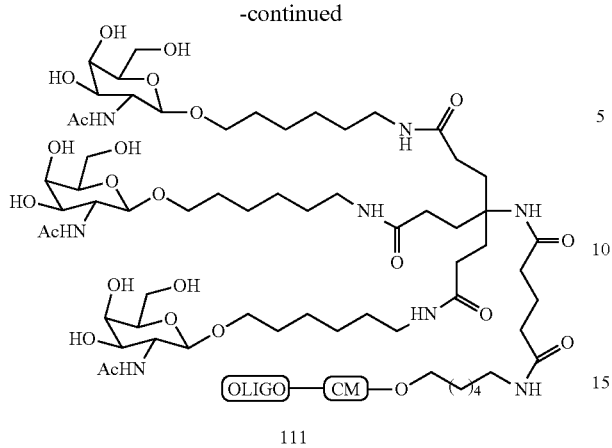

111

Oligonucleotide 111 is conjugated with GalNAc$_3$-10. The GalNAc$_3$ cluster portion of the conjugate group GalNAc$_3$-10 (GalNAc$_3$-10$_a$) can be combined with any cleavable moiety to provide a variety of conjugate groups. In certain embodiments, the cleavable moiety is —P(=O)(OH)-A$_d$-P(=O)(OH)— as shown in the oligonucleotide (ISIS 666881) synthesized with GalNAc$_3$-10 below. The structure of GalNAc$_3$-10 (GalNAc$_3$-10$_a$-CM-) is shown below:

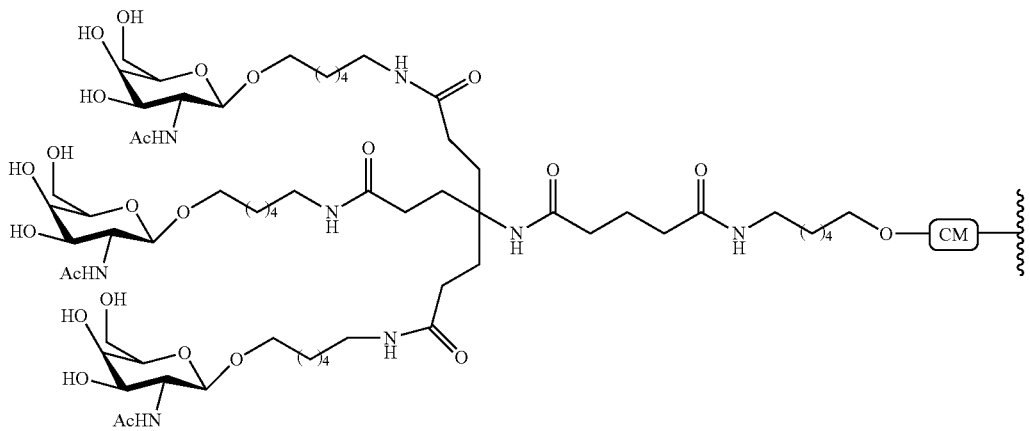

Following this general procedure ISIS 666881 was prepared. 5'-hexylamino modified oligonucleotide, ISIS 660254, was synthesized and purified using standard solid-phase oligonucleotide procedures. ISIS 660254 (40 mg, 5.2 µmol) was dissolved in 0.1 M sodium tetraborate, pH 8.5 (200 µL) and 3 equivalents PFP ester (Compound 110a) dissolved in DMSO (50 µL) was added. The PFP ester precipitated upon addition to the ASO solution requiring additional DMSO (600 µL) to fully dissolve the PFP ester. The reaction was complete after 16 h of mixing at room temperature. The solution was diluted with water to 12 mL total volume and spun down at 3000 rpm in a spin filter with a mass cut off of 3000 Da. This process was repeated twice to remove small molecule impurities. The solution was lyophilized to dryness and redissolved in concentrated aqueous ammonia with mixing at room temperature for 2.5 h followed by concentration in vacuo to remove most of the ammonia. The conjugated oligonucleotide was purified and desalted by RP-HPLC and lyophilized to give ISIS 666881 in 90% yield by weight (42 mg, 4.7 µmol).

TABLE 38a

GalNAc₁-10 conjugated oligonucleotide

| ASO | Sequence (5' to 3') | 5' group | SEQ ID No. |
|---|---|---|---|
| ISIS 660254 | NH$_2$(CH$_2$)$_6$-$_o$A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | Hexylamine | 2306 |
| ISIS 666881 | GalNAc$_3$-10$_a$-$_o$'A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-10 | 2306 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

Example 47

Preparation of Oligonucleotide 102 Comprising GalNAc$_3$-8

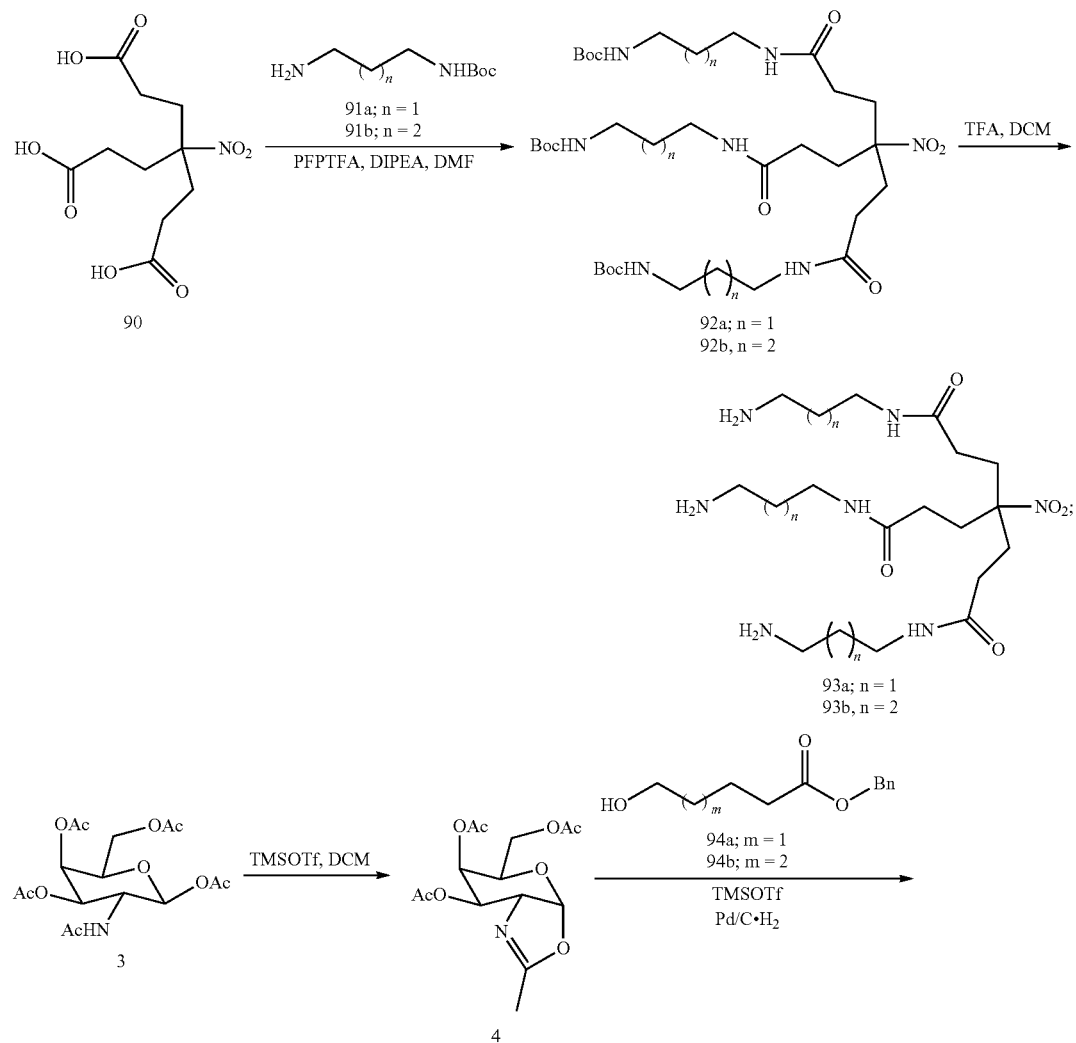

-continued
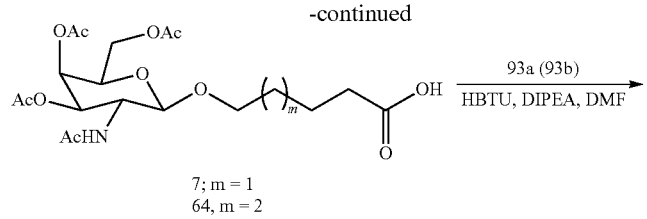
7; m = 1
64, m = 2
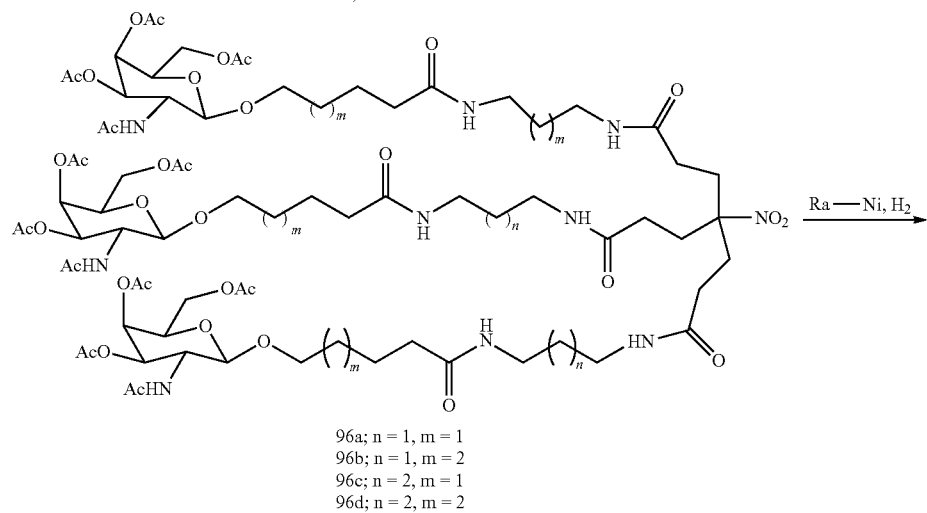
96a; n = 1, m = 1
96b; n = 1, m = 2
96c; n = 2, m = 1
96d; n = 2, m = 2
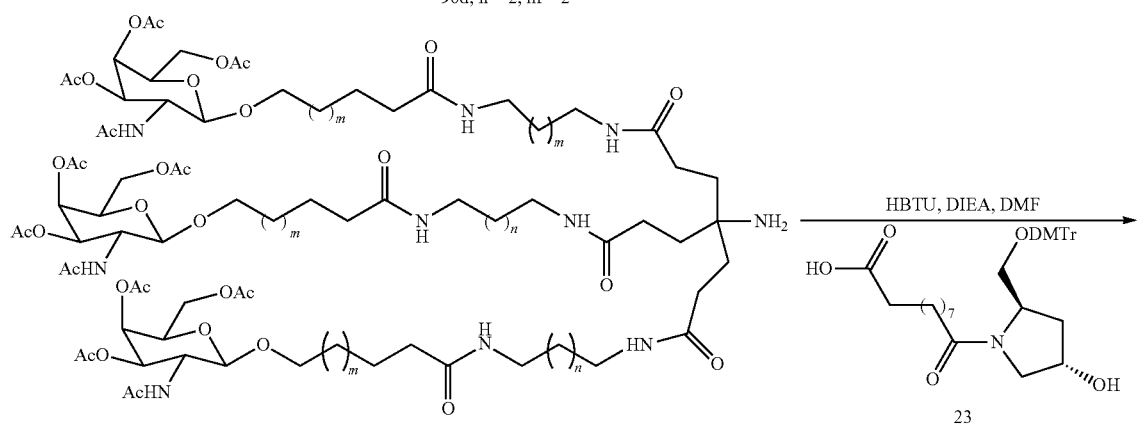
97a; n = 1, m = 1
97b; n = 1, m = 2
97c; n = 2, m = 1
97d; n = 2, m = 2
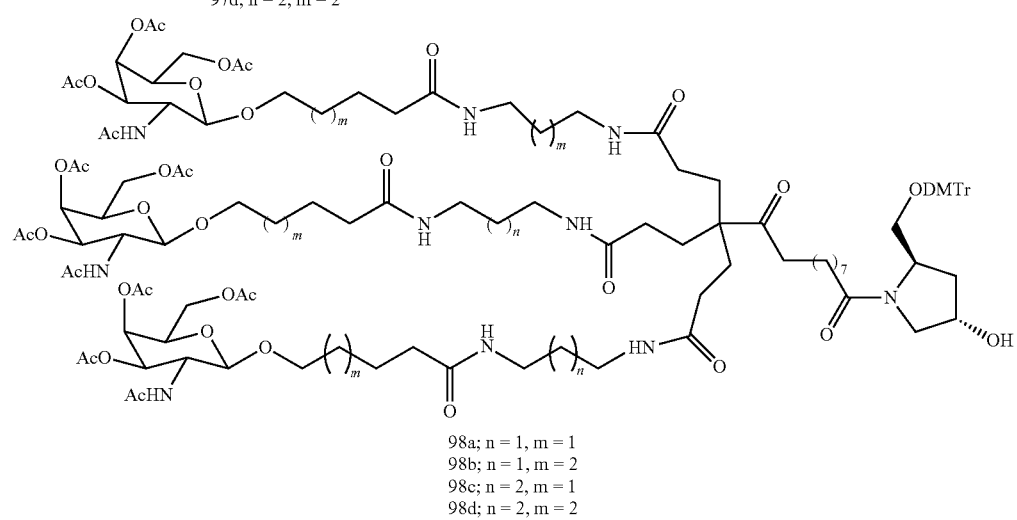
98a; n = 1, m = 1
98b; n = 1, m = 2
98c; n = 2, m = 1
98d; n = 2, m = 2

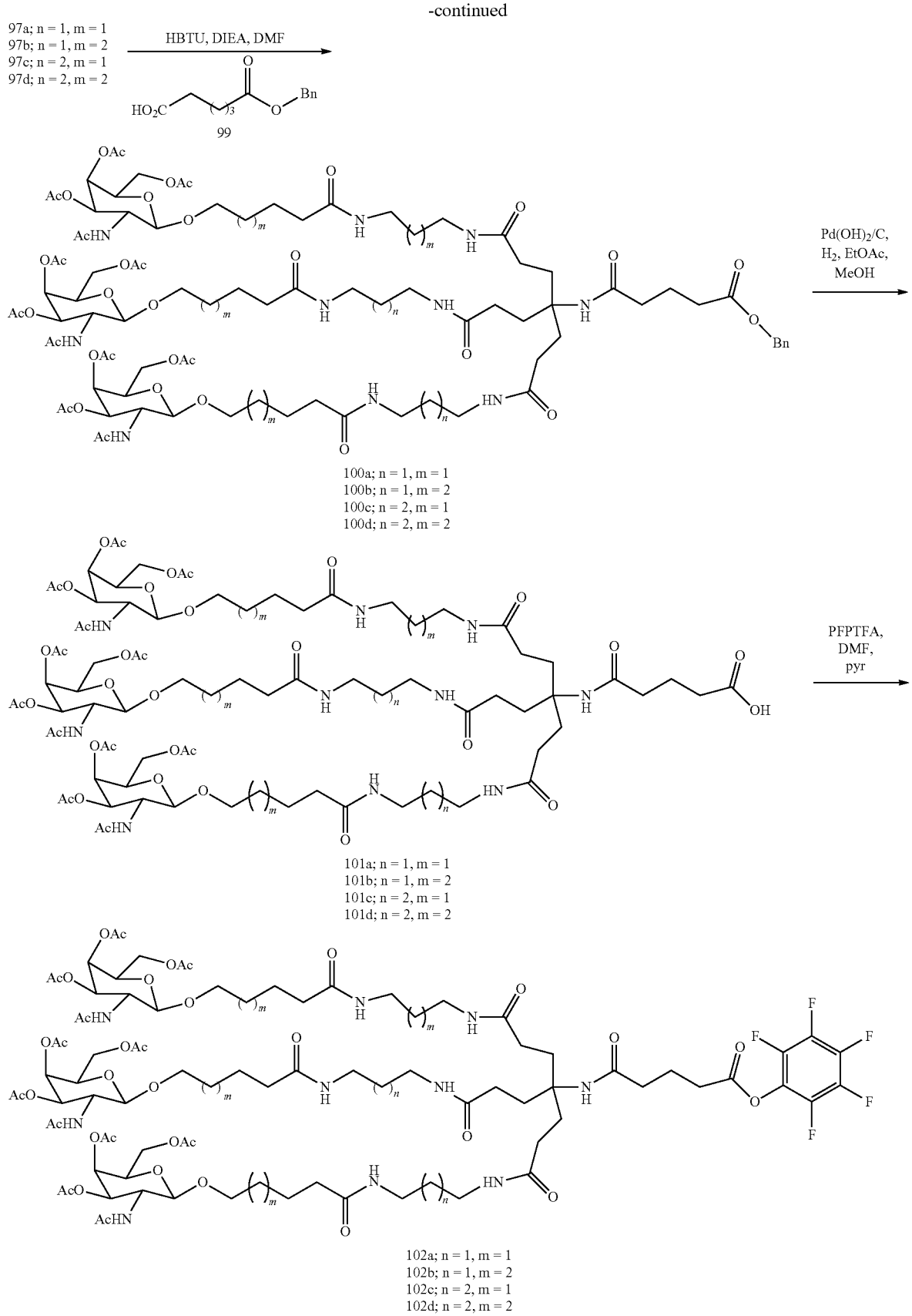

The triacid 90 (4 g, 14.43 mmol) was dissolved in DMF (120 mL) and N,N-Diisopropylethylamine (12.35 mL, 72 mmoles). Pentafluorophenyl trifluoroacetate (8.9 mL, 52 mmoles) was added dropwise, under argon, and the reaction was allowed to stir at room temperature for 30 minutes. Boc-diamine 91a or 91b (68.87 mmol) was added, along with N,N-Diisopropylethylamine (12.35 mL, 72 mmoles), and the reaction was allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%->10% methanol/dichloromethane) to give compounds 92a and 92b in an approximate 80% yield. LCMS and proton NMR were consistent with the structure.

Compound 92a or 92b (6.7 mmoles) was treated with 20 mL of dichloromethane and 20 mL of trifluoroacetic acid at room temperature for 16 hours. The resultant solution was evaporated and then dissolved in methanol and treated with DOWEX-OH resin for 30 minutes. The resultant solution was filtered and reduced to an oil under reduced pressure to give 85-90% yield of compounds 93a and 93b.

Compounds 7 or 64 (9.6 mmoles) were treated with HBTU (3.7 g, 9.6 mmoles) and N,N-Diisopropylethylamine (5 mL) in DMF (20 mL) for 15 minutes. To this was added either compounds 93a or 93b (3 mmoles), and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (5%->20% methanol/dichloromethane) to give compounds 96a-d in 20-40% yield. LCMS and proton NMR was consistent with the structure.

Compounds 96a-d (0.75 mmoles), individually, were hydrogenated over Raney Nickel for 3 hours in Ethanol (75 mL). At that time, the catalyst was removed by filtration thru celite, and the ethanol removed under reduced pressure to give compounds 97a-d in 80-90% yield. LCMS and proton NMR were consistent with the structure.

Compound 23 (0.32 g, 0.53 mmoles) was treated with HBTU (0.2 g, 0.53 mmoles) and N,N-Diisopropylethylamine (0.19 mL, 1.14 mmoles) in DMF (30 mL) for 15 minutes. To this was added compounds 97a-d (0.38 mmoles), individually, and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%->20% methanol/dichloromethane) to give compounds 98a-d in 30-40% yield. LCMS and proton NMR was consistent with the structure.

Compound 99 (0.17 g, 0.76 mmoles) was treated with HBTU (0.29 g, 0.76 mmoles) and N,N-Diisopropylethylamine (0.35 mL, 2.0 mmoles) in DMF (50 mL) for 15 minutes. To this was added compounds 97a-d (0.51 mmoles), individually, and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (5%->20% methanol/dichloromethane) to give compounds 100a-d in 40-60% yield. LCMS and proton NMR was consistent with the structure.

Compounds 100a-d (0.16 mmoles), individually, were hydrogenated over 10% Pd(OH)$_2$/C for 3 hours in methanol/ethyl acetate (1:1, 50 mL). At that time, the catalyst was removed by filtration thru celite, and the organics removed under reduced pressure to give compounds 101a-d in 80-90% yield. LCMS and proton NMR was consistent with the structure.

Compounds 101a-d (0.15 mmoles), individually, were dissolved in DMF (15 mL) and pyridine (0.016 mL, 0.2 mmoles). Pentafluorophenyl trifluoroacetate (0.034 mL, 0.2 mmoles) was added dropwise, under argon, and the reaction was allowed to stir at room temperature for 30 minutes. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%->5% methanol/dichloromethane) to give compounds 102a-d in an approximate 80% yield. LCMS and proton NMR were consistent with the structure.

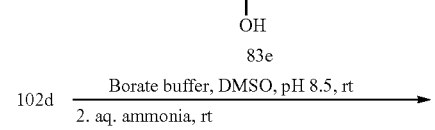

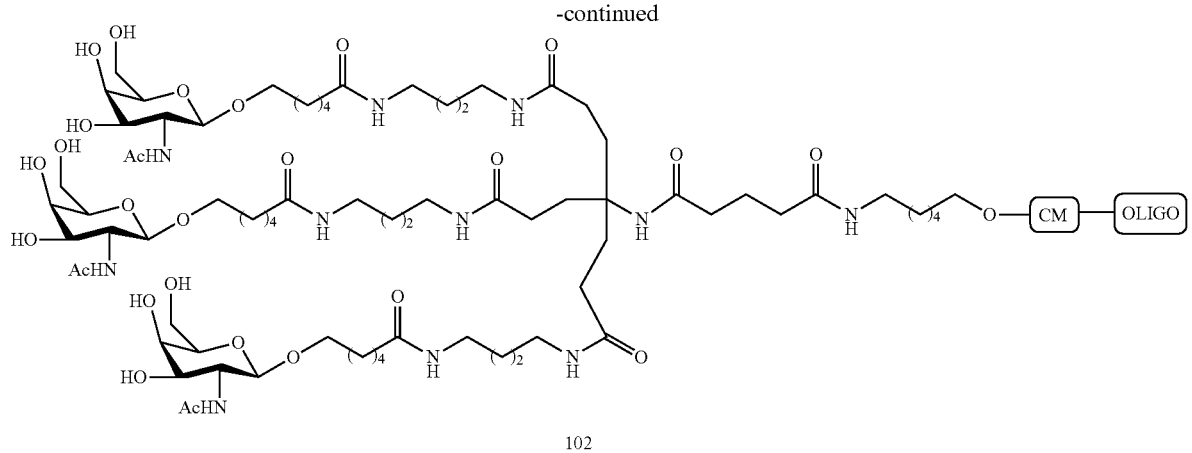

102

Oligomeric Compound 102, comprising a GalNAc$_3$-8 conjugate group, was prepared using the general procedures illustrated in Example 46. The GalNAc$_3$ cluster portion of the conjugate group GalNAc$_3$-8 (GalNAc$_3$-8$_a$) can be combined with any cleavable moiety to provide a variety of conjugate groups. In a preferred embodiment, the cleavable moiety is —P(=O)(OH)-A$_d$-P(=O)(OH)—.

The structure of GalNAc$_3$-8 (GalNAc$_3$-8$_a$-CM-) is shown below:

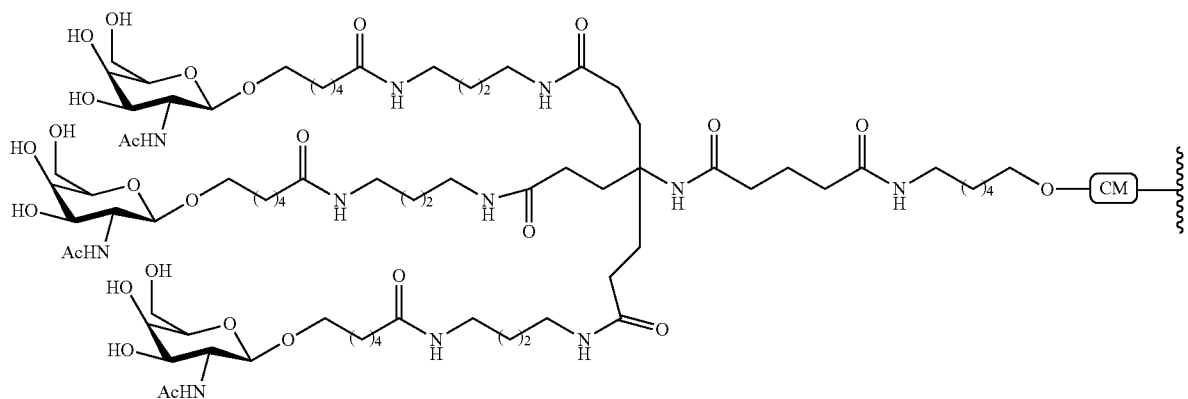

Example 48

Preparation of Oligonucleotide 119 Comprising GalNAc$_3$-7

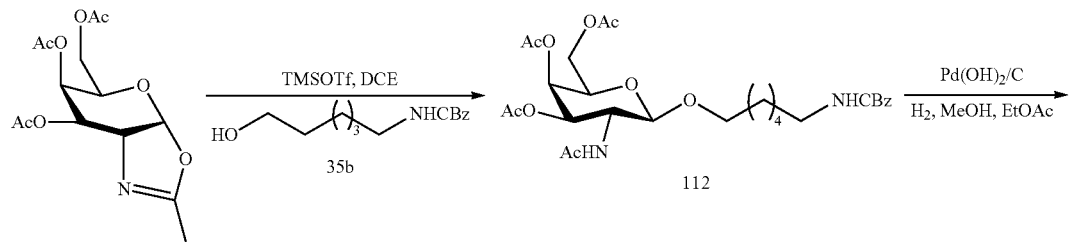

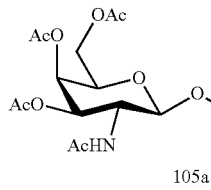
105a
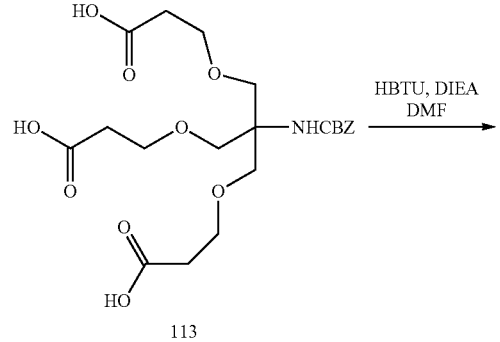
113
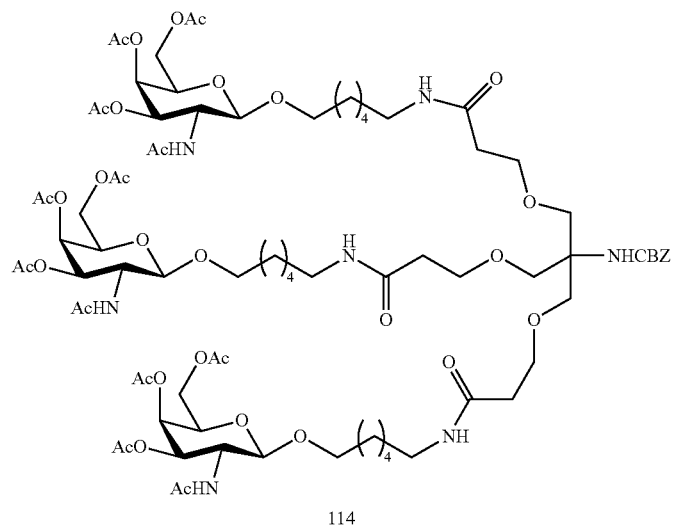
114
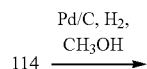
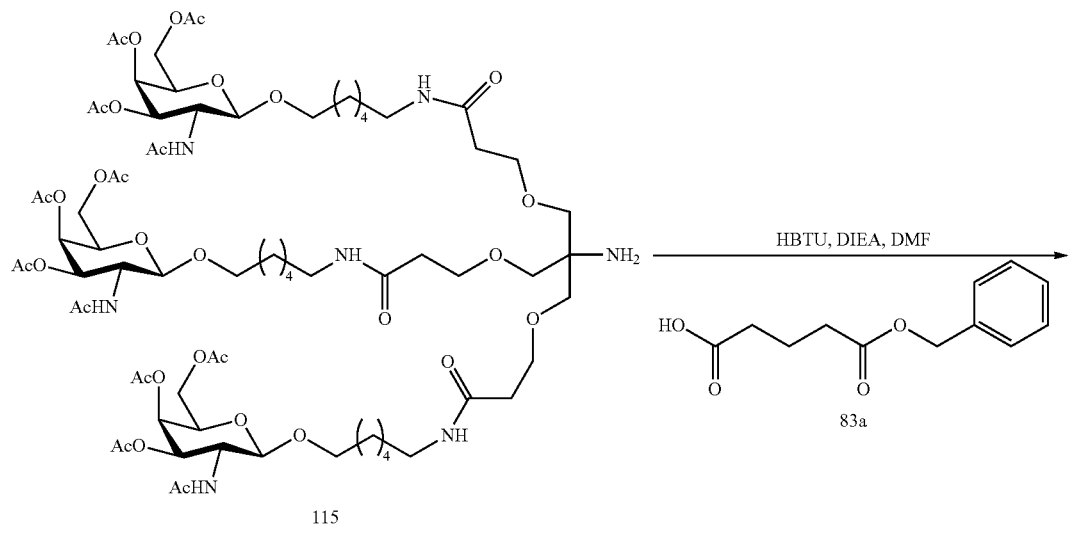
115
83a

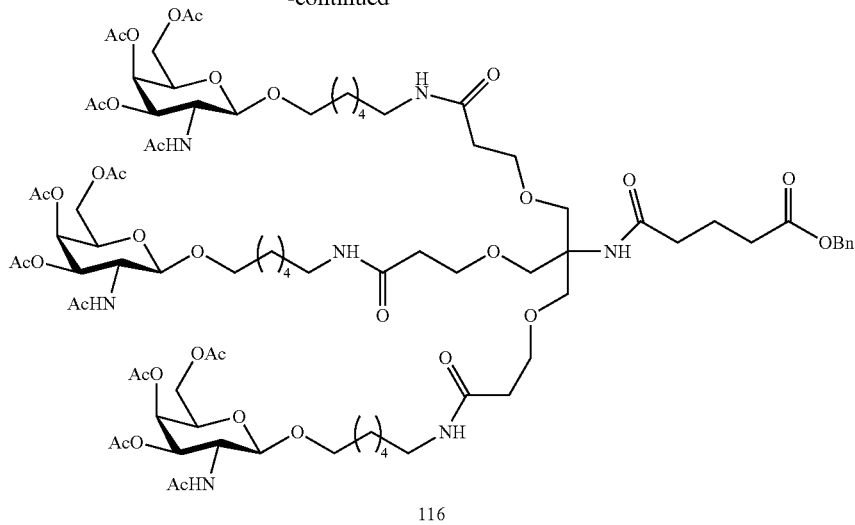

116

Compound 112 was synthesized following the procedure described in the literature (*J. Med. Chem.* 2004, 47, 5798-5808).

Compound 112 (5 g, 8.6 mmol) was dissolved in 1:1 methanol/ethyl acetate (22 mL/22 mL). Palladium hydroxide on carbon (0.5 g) was added. The reaction mixture was stirred at room temperature under hydrogen for 12 h. The reaction mixture was filtered through a pad of celite and washed the pad with 1:1 methanol/ethyl acetate. The filtrate and the washings were combined and concentrated to dryness to yield Compound 105a (quantitative). The structure was confirmed by LCMS.

Compound 113 (1.25 g, 2.7 mmol), HBTU (3.2 g, 8.4 mmol) and DIEA (2.8 mL, 16.2 mmol) were dissolved in anhydrous DMF (17 mL) and the reaction mixture was stirred at room temperature for 5 min. To this a solution of Compound 105a (3.77 g, 8.4 mmol) in anhydrous DMF (20 mL) was added. The reaction was stirred at room temperature for 6 h. Solvent was removed under reduced pressure to get an oil. The residue was dissolved in CH$_2$Cl$_2$ (100 mL) and washed with aqueous saturated NaHCO$_3$ solution (100 mL) and brine (100 mL). The organic phase was separated, dried (Na$_2$SO$_4$), filtered and evaporated. The residue was purified by silica gel column chromatography and eluted with 10 to 20% MeOH in dichloromethane to yield Compound 114 (1.45 g, 30%). The structure was confirmed by LCMS and $^1$H NMR analysis.

Compound 114 (1.43 g, 0.8 mmol) was dissolved in 1:1 methanol/ethyl acetate (4 mL/4 mL). Palladium on carbon (wet, 0.14 g) was added. The reaction mixture was flushed with hydrogen and stirred at room temperature under hydrogen for 12 h. The reaction mixture was filtered through a pad of celite. The celite pad was washed with methanol/ethyl acetate (1:1). The filtrate and the washings were combined together and evaporated under reduced pressure to yield Compound 115 (quantitative). The structure was confirmed by LCMS and $^1$H NMR analysis.

Compound 83a (0.17 g, 0.75 mmol), HBTU (0.31 g, 0.83 mmol) and DIEA (0.26 mL, 1.5 mmol) were dissolved in anhydrous DMF (5 mL) and the reaction mixture was stirred at room temperature for 5 min. To this a solution of Compound 115 (1.22 g, 0.75 mmol) in anhydrous DMF was added and the reaction was stirred at room temperature for 6 h. The solvent was removed under reduced pressure and the residue was dissolved in CH$_2$Cl$_2$. The organic layer was washed aqueous saturated NaHCO$_3$ solution and brine and dried over anhydrous Na$_2$SO$_4$ and filtered. The organic layer was concentrated to dryness and the residue obtained was purified by silica gel column chromatography and eluted with 3 to 15% MeOH in dichloromethane to yield Compound 116 (0.84 g, 61%). The structure was confirmed by LC MS and $^1$H NMR analysis.

116 →(Pd/C, H$_2$, EtOAc, MeOH)

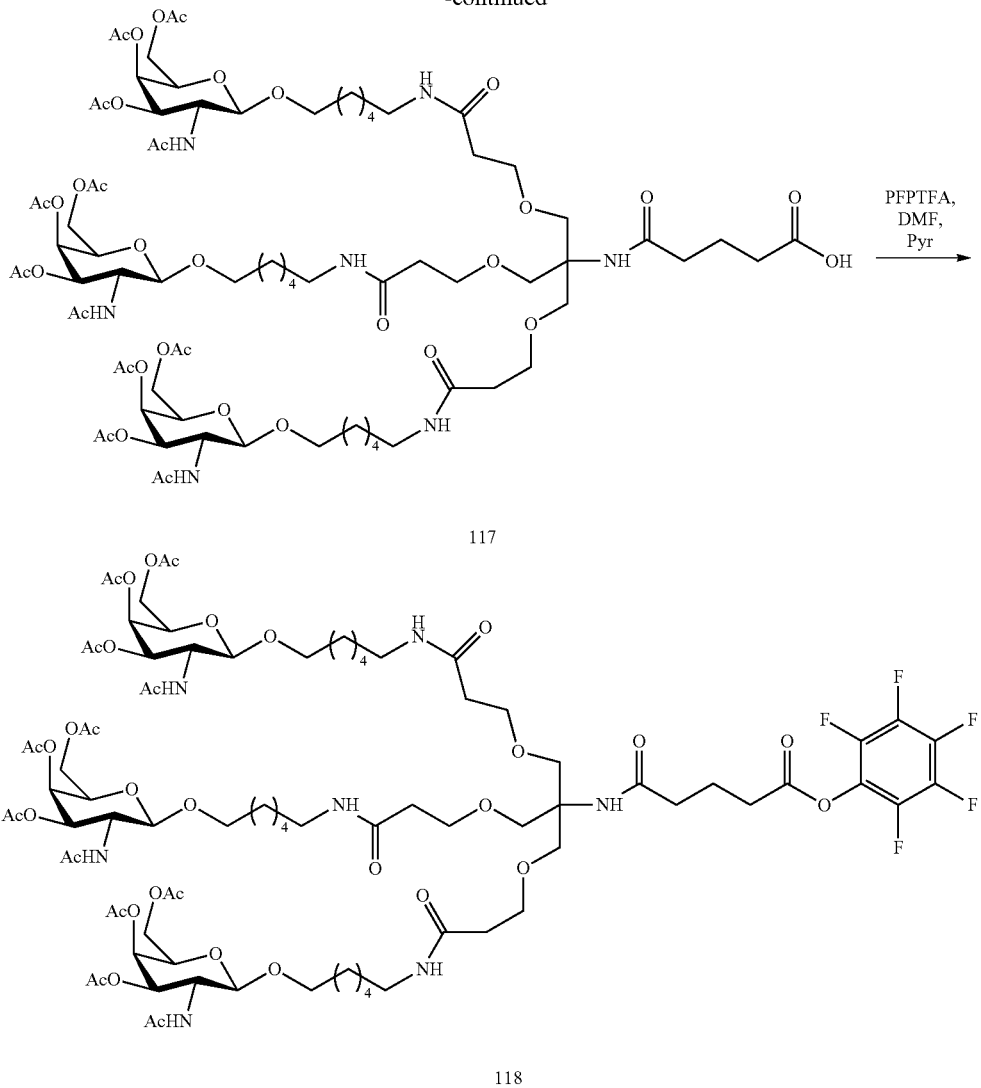

117

118

Compound 116 (0.74 g, 0.4 mmol) was dissolved in 1:1 methanol/ethyl acetate (5 mL/5 mL). Palladium on carbon (wet, 0.074 g) was added. The reaction mixture was flushed with hydrogen and stirred at room temperature under hydrogen for 12 h. The reaction mixture was filtered through a pad of celite. The celite pad was washed with methanol/ethyl acetate (1:1). The filtrate and the washings were combined together and evaporated under reduced pressure to yield compound 117 (0.73 g, 98%). The structure was confirmed by LCMS and $^1$H NMR analysis.

Compound 117 (0.63 g, 0.36 mmol) was dissolved in anhydrous DMF (3 mL). To this solution N,N-Diisopropylethylamine (70 μL, 0.4 mmol) and pentafluorophenyl trifluoroacetate (72 μL, 0.42 mmol) were added. The reaction mixture was stirred at room temperature for 12 h and poured into a aqueous saturated NaHCO$_3$ solution. The mixture was extracted with dichloromethane, washed with brine and dried over anhydrous Na$_2$SO$_4$. The dichloromethane solution was concentrated to dryness and purified with silica gel column chromatography and eluted with 5 to 10% MeOH in dichloromethane to yield compound 118 (0.51 g, 79%). The structure was confirmed by LCMS and $^1$H and $^1$H and $^{19}$F NMR.

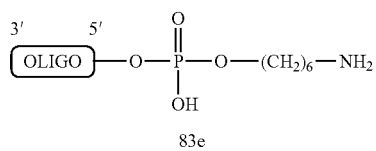

83e

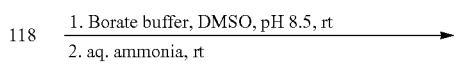

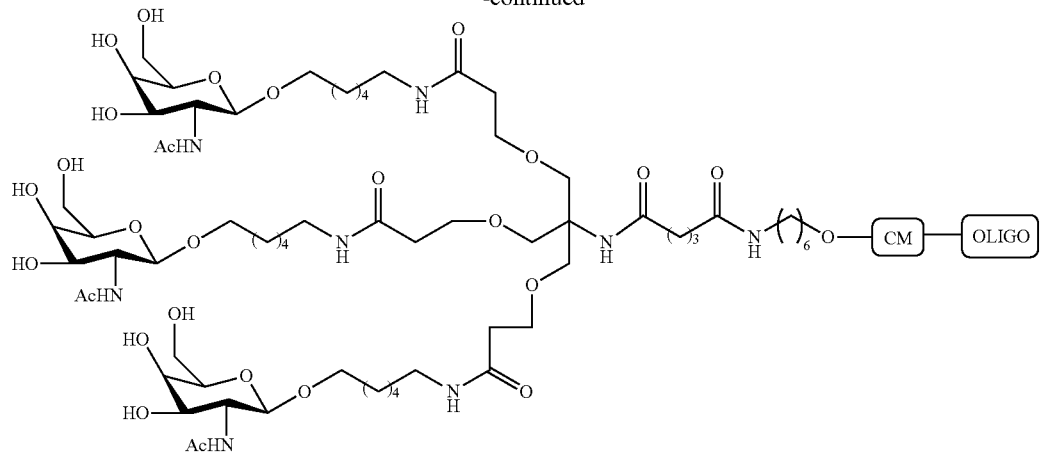

119

Oligomeric Compound 119, comprising a GalNAc$_3$-7 conjugate group, was prepared using the general procedures illustrated in Example 46. The GalNAc$_3$ cluster portion of the conjugate group GalNAc$_3$-7 (GalNAc$_3$-7$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-7 (GalNAc$_3$-7$_a$-CM-) is shown below:

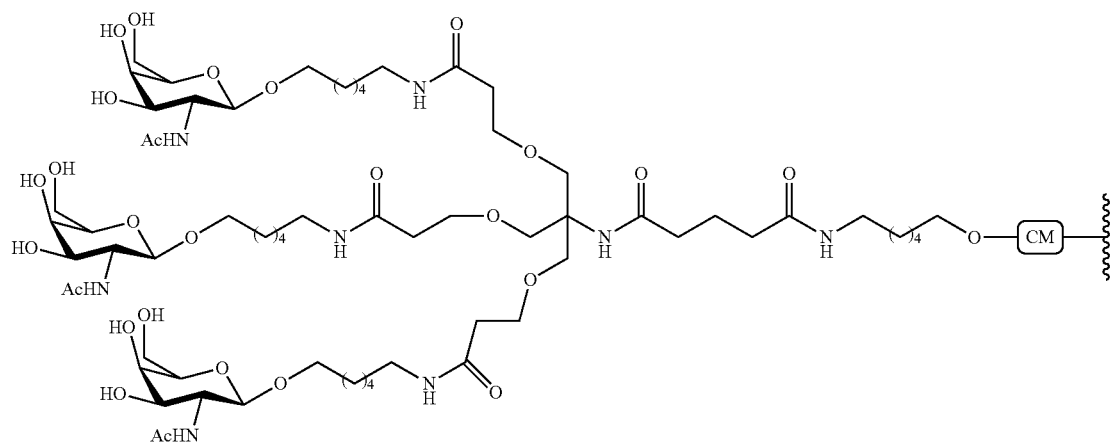

Example 49

Preparation of Oligonucleotide 132 Comprising GalNAc₃-5

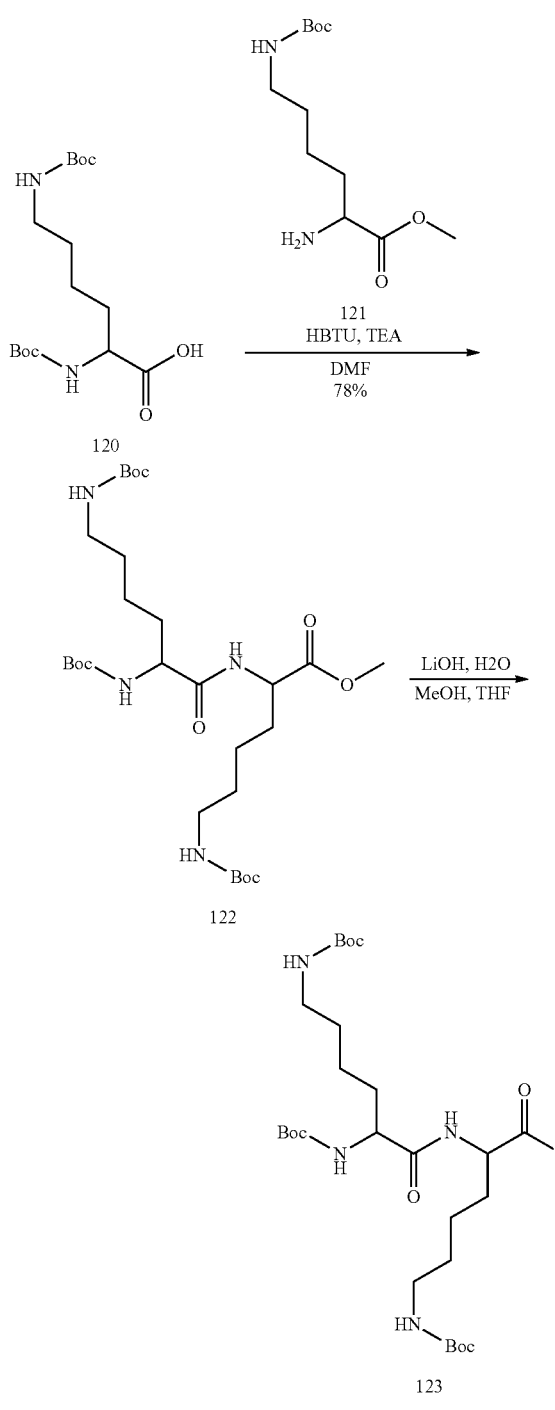

Compound 120 (14.01 g, 40 mmol) and HBTU (14.06 g, 37 mmol) were dissolved in anhydrous DMF (80 mL). Triethylamine (11.2 mL, 80.35 mmol) was added and stirred for 5 min. The reaction mixture was cooled in an ice bath and a solution of compound 121 (10 g, mmol) in anhydrous DMF (20 mL) was added. Additional triethylamine (4.5 mL, 32.28 mmol) was added and the reaction mixture was stirred for 18 h under an argon atmosphere. The reaction was monitored by TLC (ethyl acetate:hexane; 1:1; Rf=0.47). The solvent was removed under reduced pressure. The residue was taken up in EtOAc (300 mL) and washed with 1M NaHSO₄ (3×150 mL), aqueous saturated NaHCO₃ solution (3×150 mL) and brine (2×100 mL). Organic layer was dried with Na₂SO₄. Drying agent was removed by filtration and organic layer was concentrated by rotary evaporation. Crude mixture was purified by silica gel column chromatography and eluted by using 35-50% EtOAc in hexane to yield a compound 122 (15.50 g, 78.13%). The structure was confirmed by LCMS and $^1$H NMR analysis. Mass m/z 589.3 [M+H]⁺.

A solution of LiOH (92.15 mmol) in water (20 mL) and THF (10 mL) was added to a cooled solution of Compound 122 (7.75 g, 13.16 mmol) dissolved in methanol (15 mL). The reaction mixture was stirred at room temperature for 45 min. and monitored by TLC (EtOAc:hexane; 1:1). The reaction mixture was concentrated to half the volume under reduced pressure. The remaining solution was cooled an ice bath and neutralized by adding concentrated HCl. The reaction mixture was diluted, extracted with EtOAc (120 mL) and washed with brine (100 mL). An emulsion formed and cleared upon standing overnight. The organic layer was separated dried (Na₂SO₄), filtered and evaporated to yield Compound 123 (8.42 g). Residual salt is the likely cause of excess mass. LCMS is consistent with structure. Product was used without any further purification. M.W.cal: 574.36; M.W.fd: 575.3 [M+H]⁺.

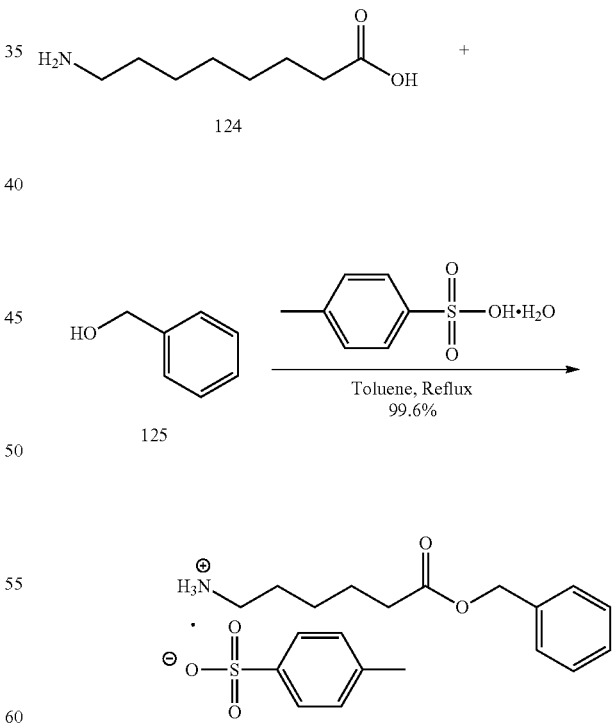

Compound 126 was synthesized following the procedure described in the literature (*J. Am. Chem. Soc.* 2011, 133, 958-963).

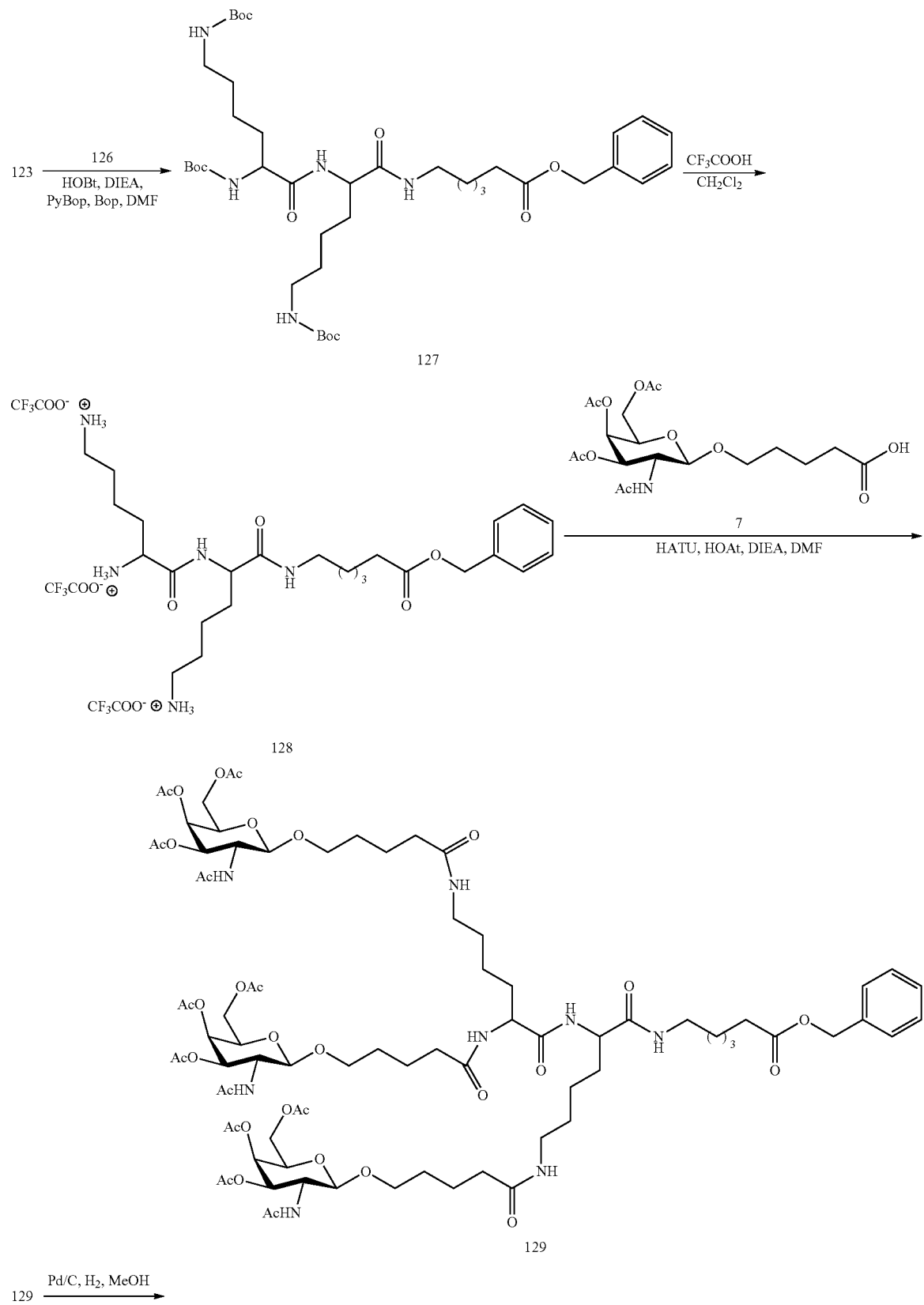

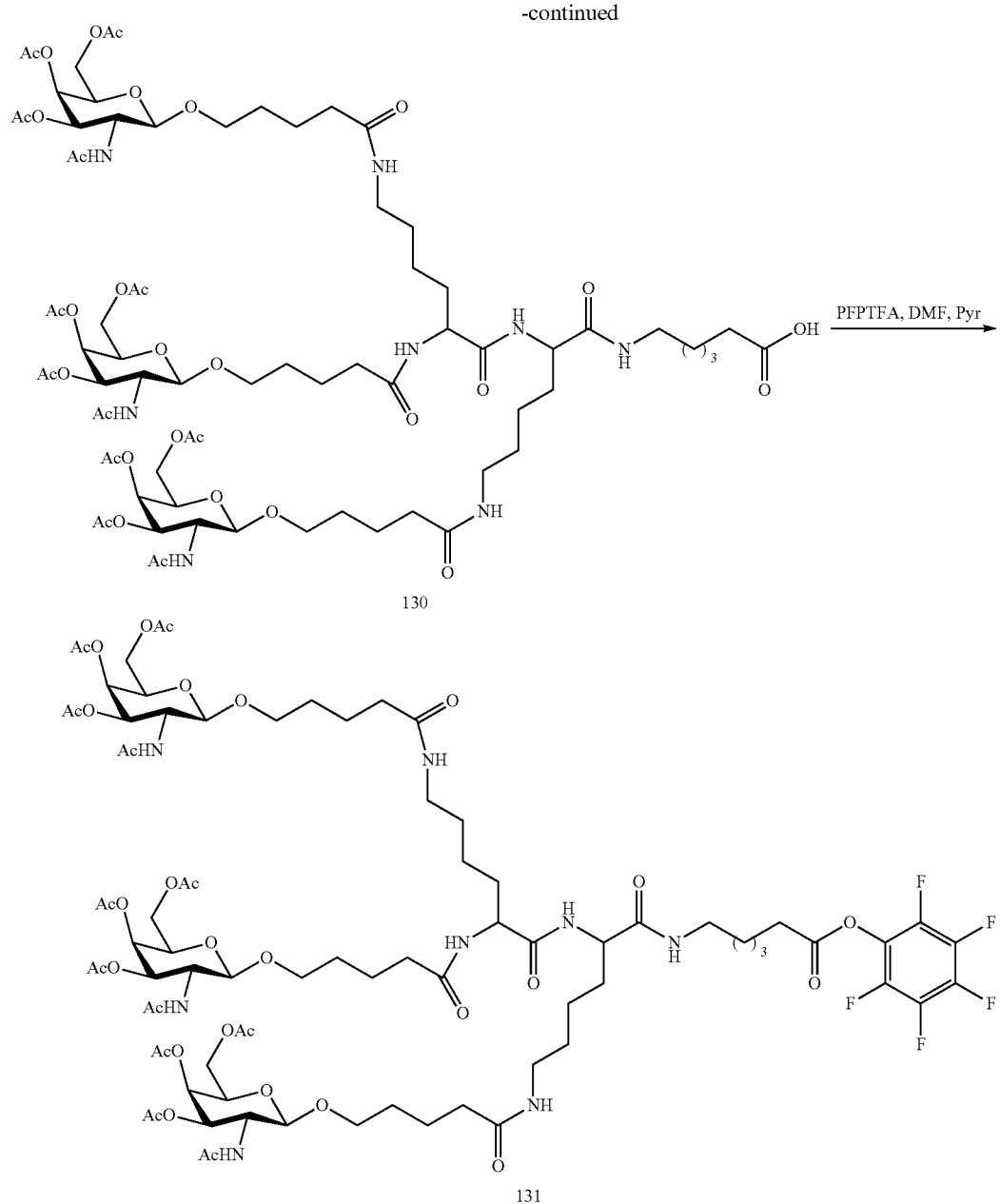

Compound 123 (7.419 g, 12.91 mmol), HOBt (3.49 g, 25.82 mmol) and compound 126 (6.33 g, 16.14 mmol) were dissolved in and DMF (40 mL) and the resulting reaction mixture was cooled in an ice bath. To this N,N-Diisopropylethylamine (4.42 mL, 25.82 mmol), PyBop (8.7 g, 16.7 mmol) followed by Bop coupling reagent (1.17 g, 2.66 mmol) were added under an argon atmosphere. The ice bath was removed and the solution was allowed to warm to room temperature. The reaction was completed after 1 h as determined by TLC (DCM:MeOH:AA; 89:10:1). The reaction mixture was concentrated under reduced pressure. The residue was dissolved in EtOAc (200 mL) and washed with 1 M NaHSO$_4$ (3×100 mL), aqueous saturated NaHCO$_3$ (3×100 mL) and brine (2×100 mL). The organic phase separated dried (Na$_2$SO$_4$), filtered and concentrated. The residue was purified by silica gel column chromatography with a gradient of 50% hexanes/EtOAC to 100% EtOAc to yield Compound 127 (9.4 g) as a white foam. LCMS and $^1$H NMR were consistent with structure. Mass m/z 778.4 [M+H]$^+$.

Trifluoroacetic acid (12 mL) was added to a solution of compound 127 (1.57 g, 2.02 mmol) in dichloromethane (12 mL) and stirred at room temperature for 1 h. The reaction mixture was co-evaporated with toluene (30 mL) under reduced pressure to dryness. The residue obtained was co-evaporated twice with acetonitrile (30 mL) and toluene (40 mL) to yield Compound 128 (1.67 g) as trifluoro acetate salt and used for next step without further purification. LCMS and $^1$H NMR were consistent with structure. Mass m/z 478.2 [M+H]$^+$.

Compound 7 (0.43 g, 0.963 mmol), HATU (0.35 g, 0.91 mmol), and HOAt (0.035 g, 0.26 mmol) were combined together and dried for 4 h over P$_2$O$_5$ under reduced pressure in a round bottom flask and then dissolved in anhydrous DMF (1 mL) and stirred for 5 min. To this a solution of compound 128 (0.20 g, 0.26 mmol) in anhydrous DMF (0.2 mL) and N,N-Diisopropylethylamine (0.2 mL) was added. The reaction mixture was stirred at room temperature under an argon atmosphere. The reaction was complete after 30 min as determined by LCMS and TLC (7% MeOH/DCM). The reaction mixture was concentrated under reduced pressure. The residue was dissolved in DCM (30 mL) and washed with 1 M NaHSO$_4$ (3×20 mL), aqueous saturated NaHCO$_3$ (3×20 mL) and brine (3×20 mL). The organic phase was separated, dried over Na$_2$SO$_4$, filtered and concentrated. The residue was purified by silica gel column chromatography using 5-15% MeOH in dichloromethane to yield Compound 129 (96.6 mg). LC MS and $^1$H NMR are consistent with structure. Mass m/z 883.4 [M+2H]$^+$.

LCMS and $^1$H NMR were consistent with structure. The product was used without further purification. Mass m/z 838.3 [M+2H]$^+$.

To a 10 mL pointed round bottom flask were added compound 130 (75.8 mg, 0.046 mmol), 0.37 M pyridine/DMF (200 μL) and a stir bar. To this solution was added 0.7 M pentafluorophenyl trifluoroacetate/DMF (100 μL) drop wise with stirring. The reaction was completed after 1 h as determined by LC MS. The solvent was removed under reduced pressure and the residue was dissolved in CHCl$_3$ (~10 mL). The organic layer was partitioned against NaHSO$_4$ (1 M, 10 mL), aqueous saturated NaHCO$_3$ (10 mL) and brine (10 mL) three times each. The organic phase separated and dried over Na$_2$SO$_4$, filtered and concentrated to yield Compound 131 (77.7 mg). LCMS is consistent with structure. Used without further purification. Mass m/z 921.3 [M+2H]$^+$.

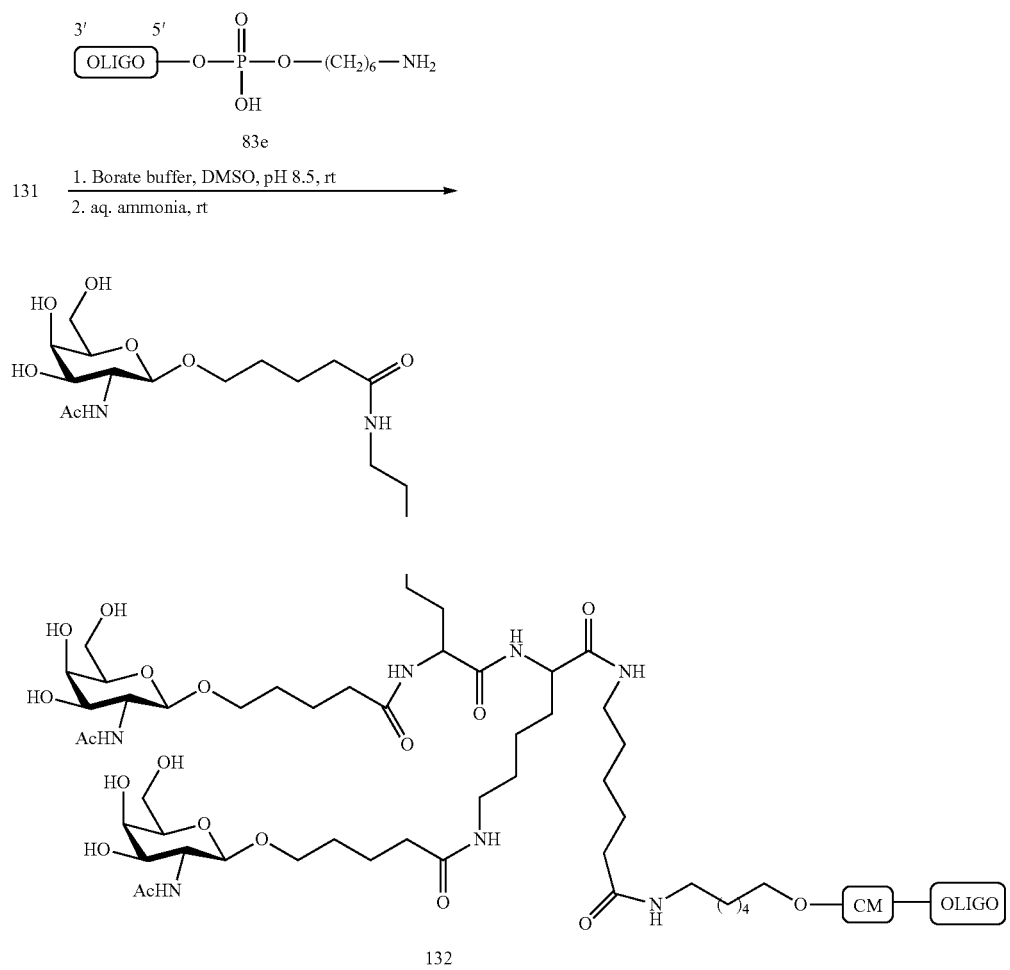

Compound 129 (0.09 g, 0.051 mmol) was dissolved in methanol (5 mL) in 20 mL scintillation vial. To this was added a small amount of 10% Pd/C (0.015 mg) and the reaction vessel was flushed with H$_2$ gas. The reaction mixture was stirred at room temperature under H$_2$ atmosphere for 18 h. The reaction mixture was filtered through a pad of Celite and the Celite pad was washed with methanol. The filtrate washings were pooled together and concentrated under reduced pressure to yield Compound 130 (0.08 g).

Oligomeric Compound 132, comprising a GalNAc$_3$-5 conjugate group, was prepared using the general procedures illustrated in Example 46. The GalNAc$_3$ cluster portion of the conjugate group GalNAc$_3$-5 (GalNAc$_3$-5$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-5 (GalNAc$_3$-5$_a$-CM-) is shown below:

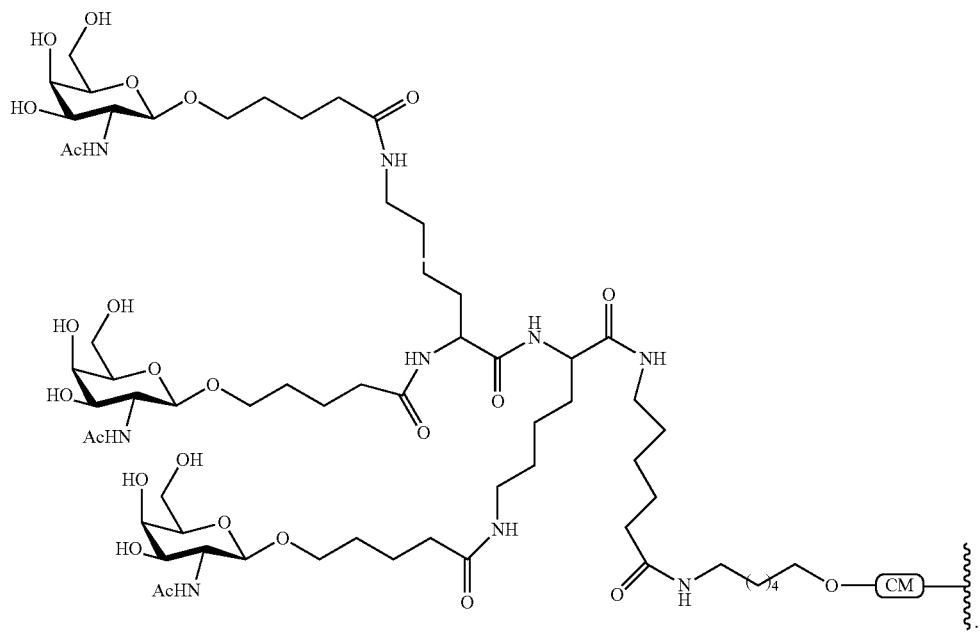
Example 50
Preparation of Oligonucleotide 144 Comprising GalNAc$_4$-11
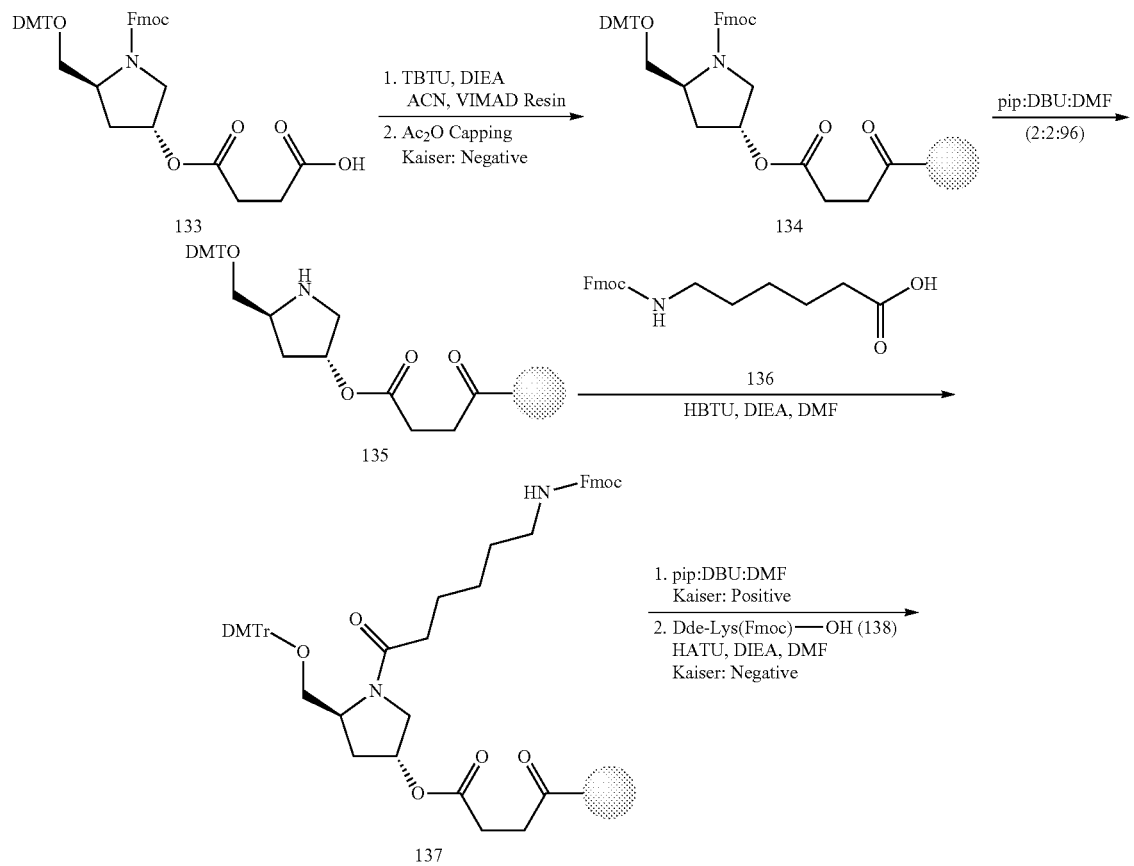

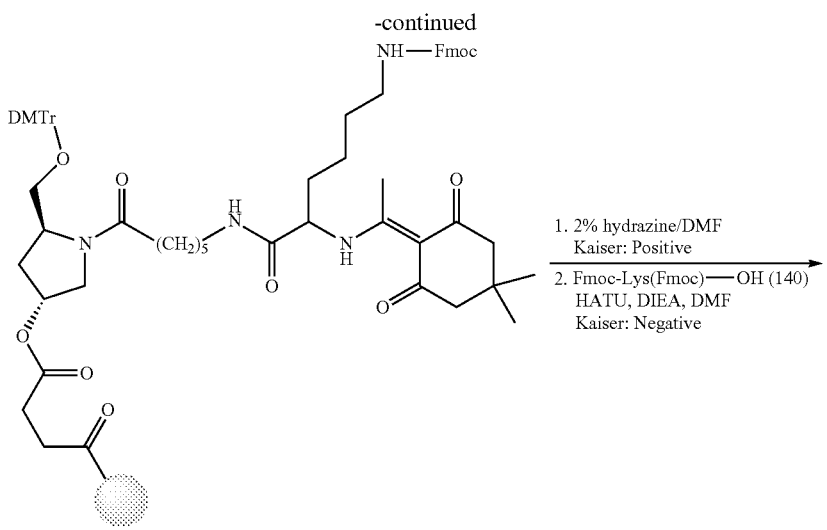
139
1. 2% hydrazine/DMF
   Kaiser: Positive
2. Fmoc-Lys(Fmoc)—OH (140)
   HATU, DIEA, DMF
   Kaiser: Negative
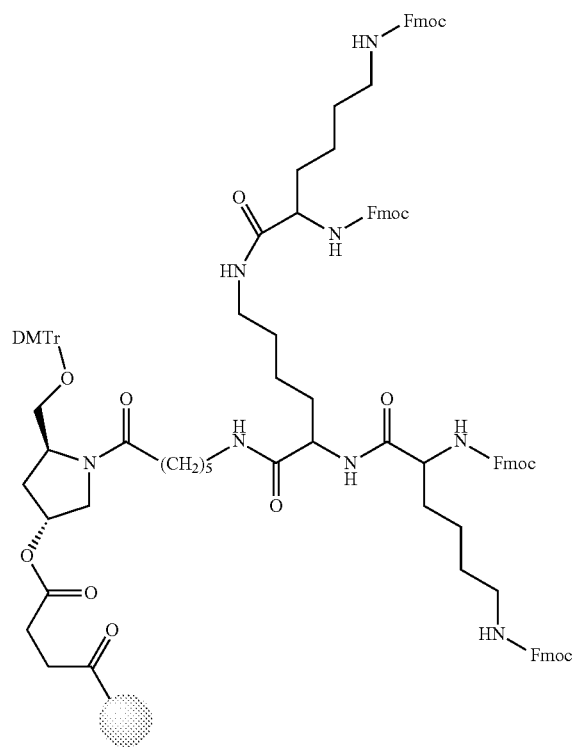
141
141 →
1. pip:DBU:DMF
   Kaiser: Positive
2. 7, HATU, DIEA, DMF
   Kaiser: Negative

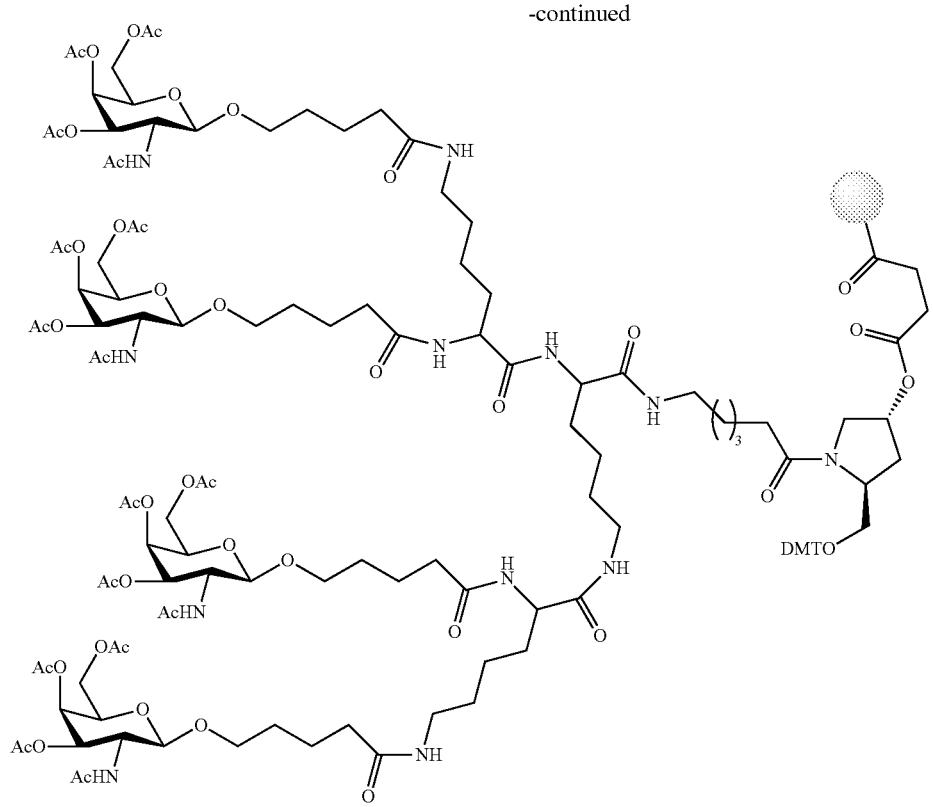

142

Synthesis of Compound 134: To a Merrifield flask was added aminomethyl VIMAD resin (2.5 g, 450 μmol/g) that was washed with acetonitrile, dimethylformamide, dichloromethane and acetonitrile. The resin was swelled in acetonitrile (4 mL). Compound 133 was pre-activated in a 100 mL round bottom flask by adding 20 (1.0 mmol, 0.747 g), TBTU (1.0 mmol, 0.321 g), acetonitrile (5 mL) and DIEA (3.0 mmol, 0.5 mL). This solution was allowed to stir for 5 min and was then added to the Merrifield flask with shaking. The suspension was allowed to shake for 3 h. The reaction mixture was drained and the resin was washed with acetonitrile, DMF and DCM. New resin loading was quantitated by measuring the absorbance of the DMT cation at 500 nm (extinction coefficient=76000) in DCM and determined to be 238 μmol/g. The resin was capped by suspending in an acetic anhydride solution for ten minutes three times.

The solid support bound compound 141 was synthesized using iterative Fmoc-based solid phase peptide synthesis methods. A small amount of solid support was withdrawn and suspended in aqueous ammonia (28-30 wt %) for 6 h. The cleaved compound was analyzed by LC-MS and the observed mass was consistent with structure. Mass m/z 1063.8 [M+2H]$^+$.

The solid support bound compound 142 was synthesized using solid phase peptide synthesis methods.

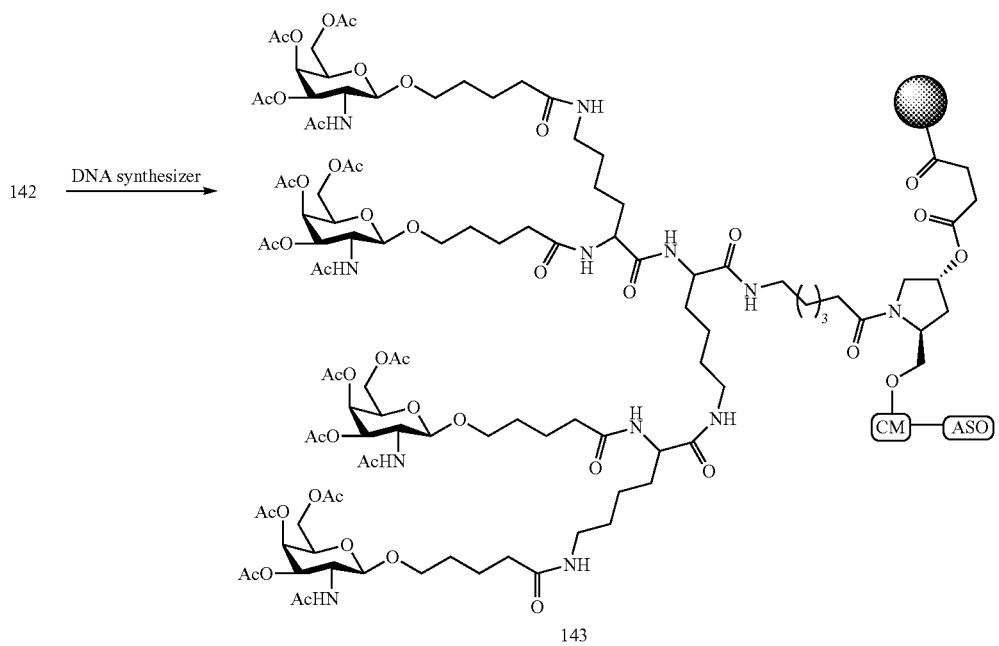

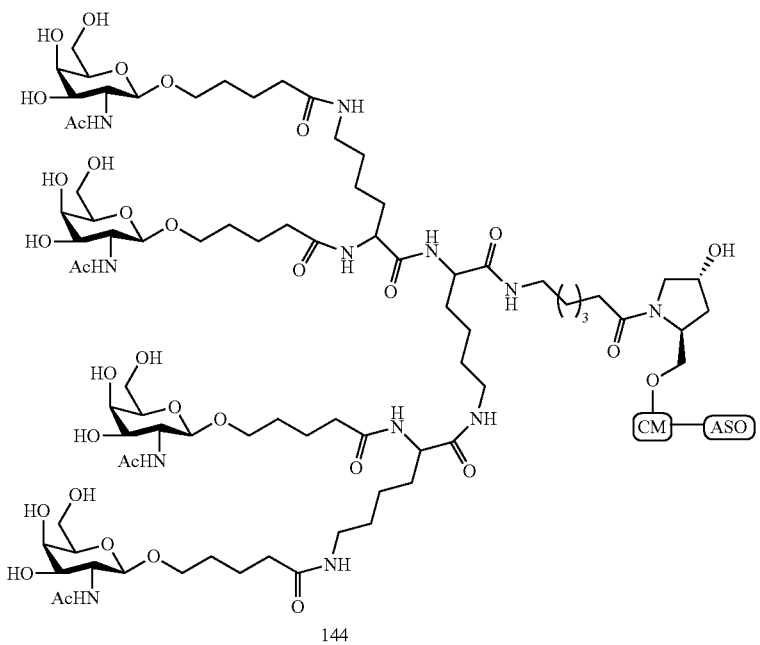

The solid support bound compound 143 was synthesized using standard solid phase synthesis on a DNA synthesizer.

The solid support bound compound 143 was suspended in aqueous ammonia (28-30 wt %) and heated at 55° C. for 16 h. The solution was cooled and the solid support was filtered. The filtrate was concentrated and the residue dissolved in water and purified by HPLC on a strong anion exchange column. The fractions containing full length compound 144 were pooled together and desalted. The resulting GalNAc$_4$-11 conjugated oligomeric compound was analyzed by LC-MS and the observed mass was consistent with structure.

The GalNAc$_4$ cluster portion of the conjugate group GalNAc$_4$-11 (GalNAc$_4$-11$_a$) can be combined with any cleavable moiety to provide a variety of conjugate groups. In certain embodiments, the cleavable moiety is —P(=O)(OH)-A$_d$-P(=O)(OH)—.

The structure of GalNAc$_4$-11 (GalNAc$_4$-11$_a$-CM) is shown below:

311    312
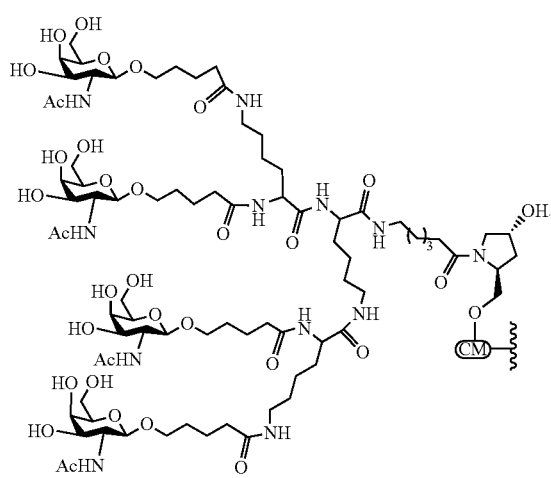
Example 51
Preparation of Oligonucleotide 155 Comprising GalNAc$_3$-6
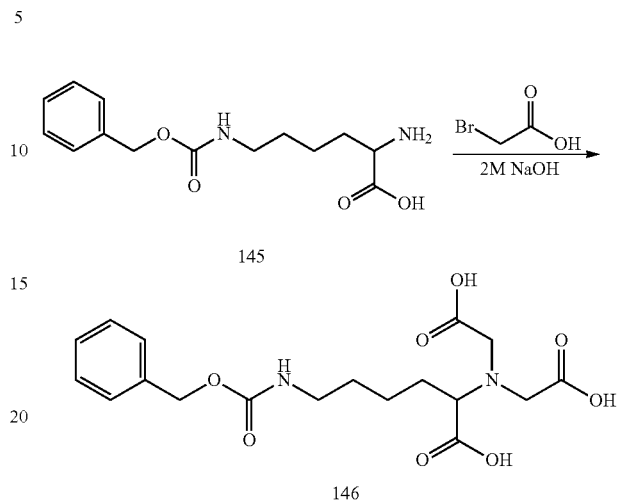
Compound 146 was synthesized as described in the literature (*Analytical Biochemistry* 1995, 229, 54-60).
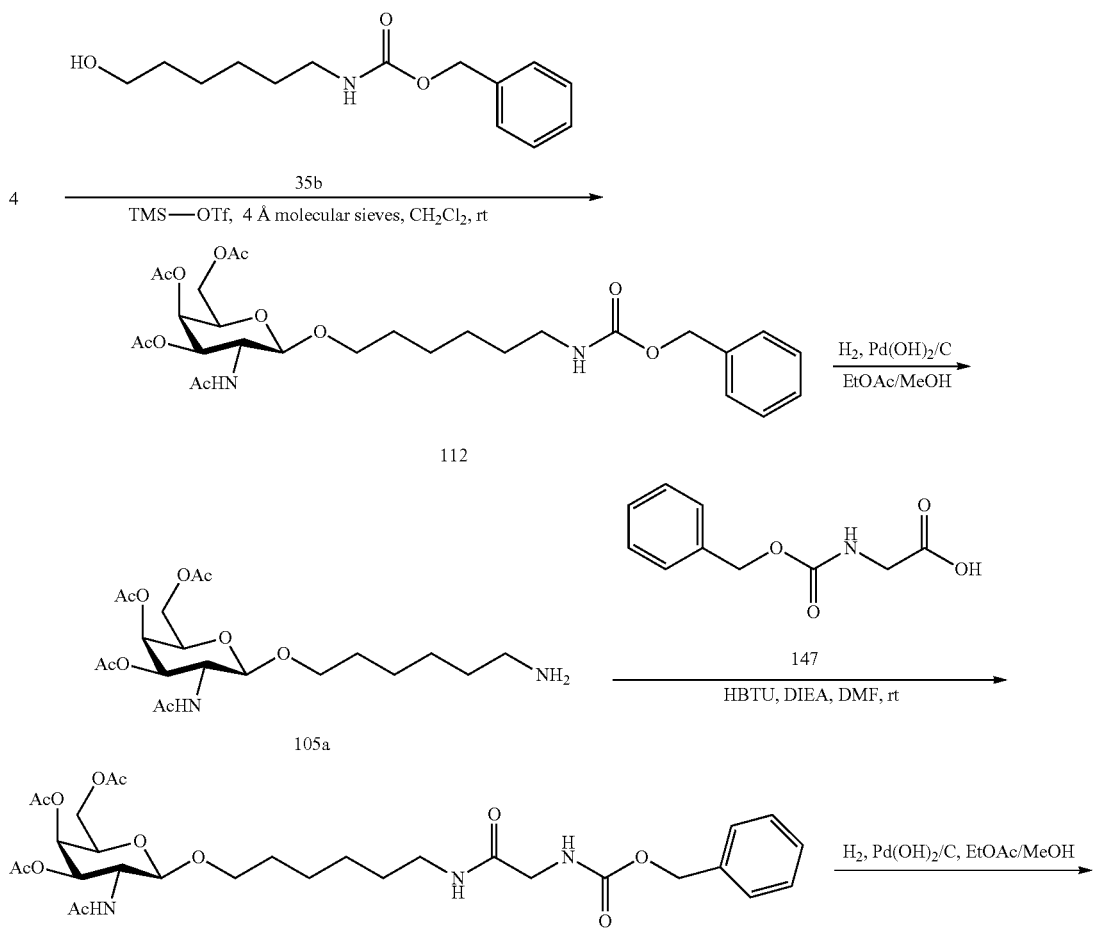

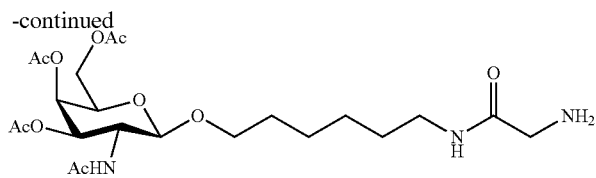

149

Compound 4 (15 g, 45.55 mmol) and compound 35b (14.3 grams, 57 mmol) were dissolved in CH$_2$Cl$_2$ (200 ml). Activated molecular sieves (4 Å. 2 g, powdered) were added, and the reaction was allowed to stir for 30 minutes under nitrogen atmosphere. TMS-OTf was added (4.1 ml, 22.77 mmol) and the reaction was allowed to stir at room temp overnight. Upon completion, the reaction was quenched by pouring into solution of saturated aqueous NaHCO$_3$ (500 ml) and crushed ice (~150 g). The organic layer was separated, washed with brine, dried over MgSO$_4$, filtered, and was concentrated to an orange oil under reduced pressure. The crude material was purified by silica gel column chromatography and eluted with 2-10% MeOH in CH$_2$Cl$_2$ to yield Compound 112 (16.53 g, 63%). LCMS and $^1$H NMR were consistent with the expected compound.

Compound 112 (4.27 g, 7.35 mmol) was dissolved in 1:1 MeOH/EtOAc (40 ml). The reaction mixture was purged by bubbling a stream of argon through the solution for 15 minutes. Pearlman's catalyst (palladium hydroxide on carbon, 400 mg) was added, and hydrogen gas was bubbled through the solution for 30 minutes. Upon completion (TLC 10% MeOH in CH$_2$Cl$_2$, and LCMS), the catalyst was removed by filtration through a pad of celite. The filtrate was concentrated by rotary evaporation, and was dried briefly under high vacuum to yield Compound 105a (3.28 g). LCMS and 1H NMR were consistent with desired product.

Compound 147 (2.31 g, 11 mmol) was dissolved in anhydrous DMF (100 mL). N,N-Diisopropylethylamine (DIEA, 3.9 mL, 22 mmol) was added, followed by HBTU (4 g, 10.5 mmol). The reaction mixture was allowed to stir for ~15 minutes under nitrogen. To this a solution of compound 105a (3.3 g, 7.4 mmol) in dry DMF was added and stirred for 2 h under nitrogen atmosphere. The reaction was diluted with EtOAc and washed with saturated aqueous NaHCO$_3$ and brine. The organics phase was separated, dried (MgSO$_4$), filtered, and concentrated to an orange syrup. The crude material was purified by column chromatography 2-5% MeOH in CH$_2$Cl$_2$ to yield Compound 148 (3.44 g, 73%). LCMS and $^1$H NMR were consistent with the expected product.

Compound 148 (3.3 g, 5.2 mmol) was dissolved in 1:1 MeOH/EtOAc (75 ml). The reaction mixture was purged by bubbling a stream of argon through the solution for 15 minutes. Pearlman's catalyst (palladium hydroxide on carbon) was added (350 mg). Hydrogen gas was bubbled through the solution for 30 minutes. Upon completion (TLC 10% MeOH in DCM, and LCMS), the catalyst was removed by filtration through a pad of celite. The filtrate was concentrated by rotary evaporation, and was dried briefly under high vacuum to yield Compound 149 (2.6 g). LCMS was consistent with desired product. The residue was dissolved in dry DMF (10 ml) was used immediately in the next step.

146 $\xrightarrow[\text{HBTU, DIEA, DMF}]{149}$

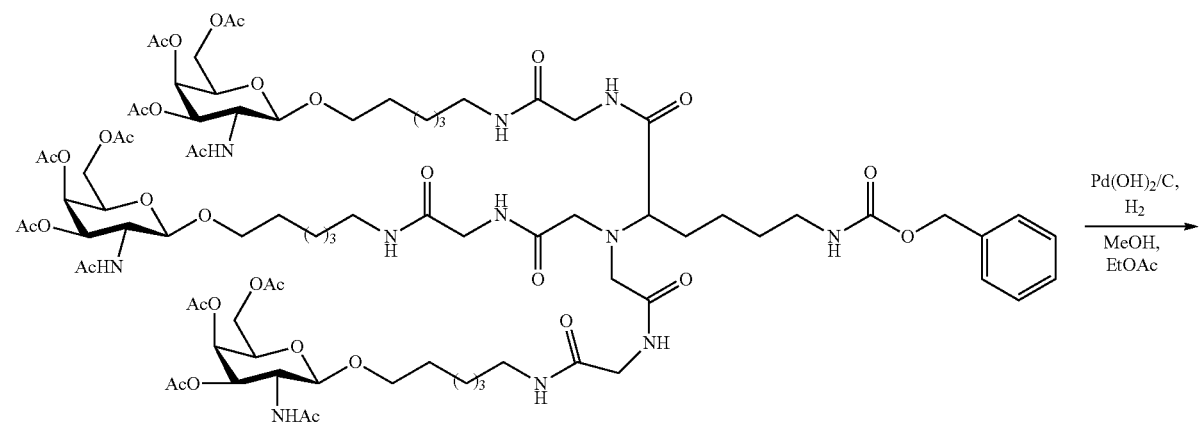

150

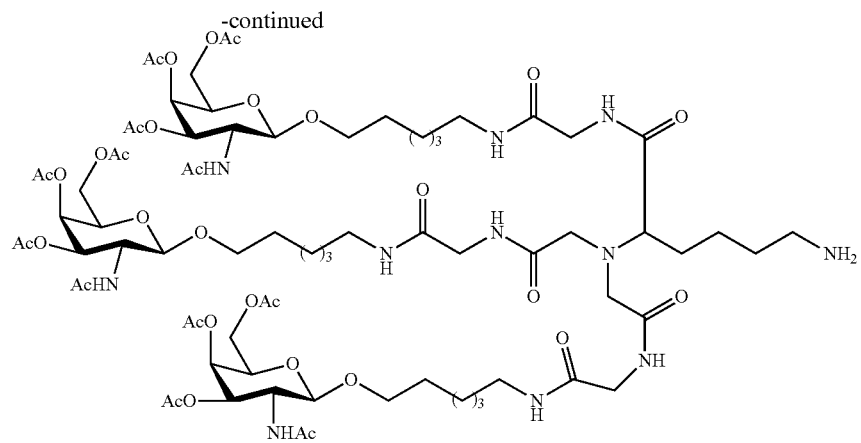

151

Compound 146 (0.68 g, 1.73 mmol) was dissolved in dry DMF (20 ml). To this DIEA (450 µL, 2.6 mmol, 1.5 eq.) and HBTU (1.96 g, 0.5.2 mmol) were added. The reaction mixture was allowed to stir for 15 minutes at room temperature under nitrogen. A solution of compound 149 (2.6 g) in anhydrous DMF (10 mL) was added. The pH of the reaction was adjusted to pH=9-10 by addition of DIEA (if necessary). The reaction was allowed to stir at room temperature under nitrogen for 2 h. Upon completion the reaction was diluted with EtOAc (100 mL), and washed with aqueous saturated aqueous NaHCO$_3$, followed by brine. The organic phase was separated, dried over MgSO$_4$, filtered, and concentrated. The residue was purified by silica gel column chromatography and eluted with 2-10% MeOH in CH$_2$Cl$_2$ to yield Compound 150 (0.62 g, 20%). LCMS and $^1$H NMR were consistent with the desired product.

Compound 150 (0.62 g) was dissolved in 1:1 MeOH/EtOAc (5 L). The reaction mixture was purged by bubbling a stream of argon through the solution for 15 minutes. Pearlman's catalyst (palladium hydroxide on carbon) was added (60 mg). Hydrogen gas was bubbled through the solution for 30 minutes. Upon completion (TLC 10% MeOH in DCM, and LCMS), the catalyst was removed by filtration (syringe-tip Teflon filter, 0.45 µm). The filtrate was concentrated by rotary evaporation, and was dried briefly under high vacuum to yield Compound 151 (0.57 g). The LCMS was consistent with the desired product. The product was dissolved in 4 mL dry DMF and was used immediately in the next step.

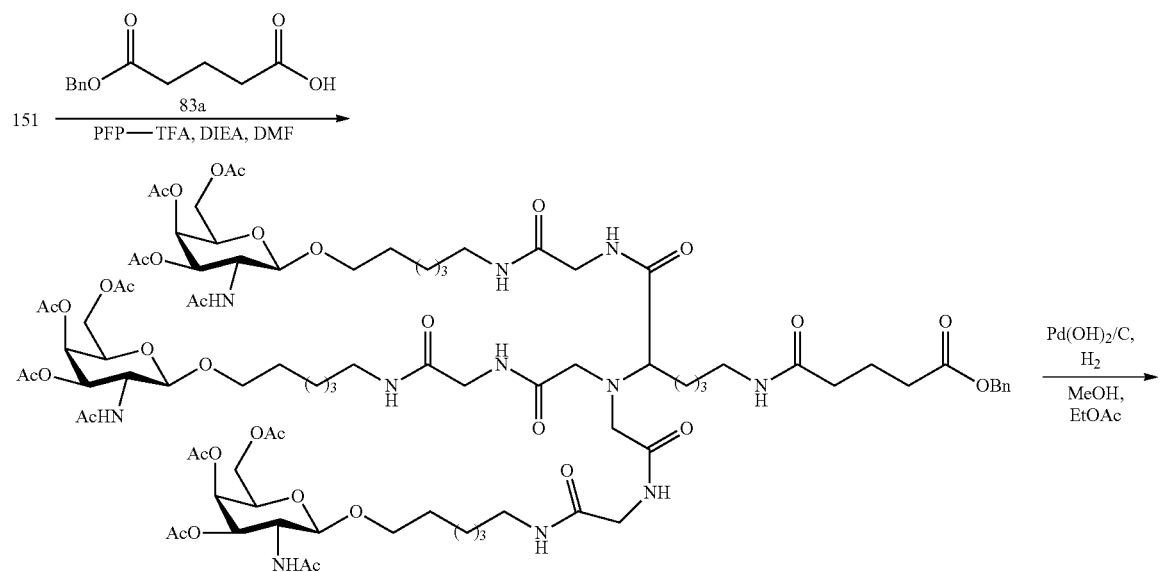

152

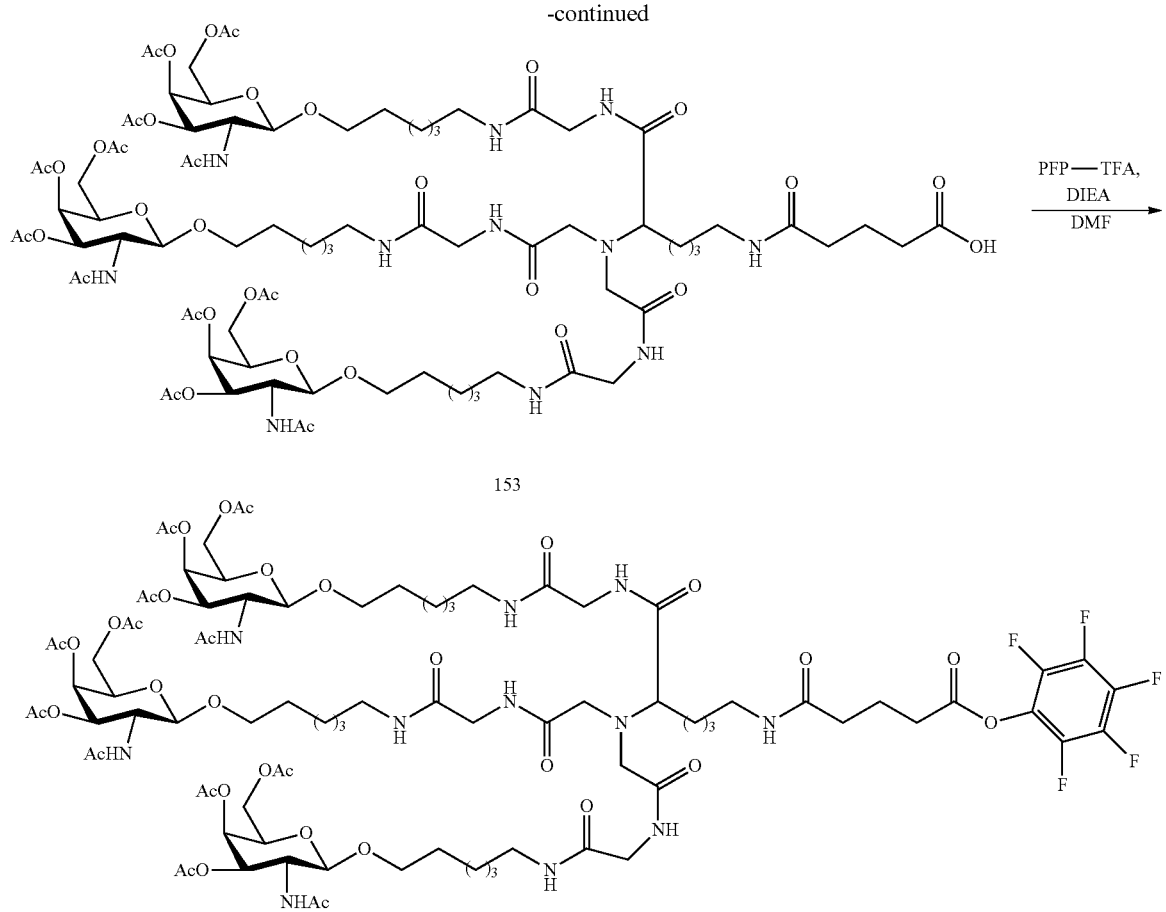

Compound 83a (0.11 g, 0.33 mmol) was dissolved in anhydrous DMF (5 mL) and N,N-Diisopropylethylamine (75 µL, 1 mmol) and PFP-TFA (90 µL, 0.76 mmol) were added. The reaction mixture turned magenta upon contact, and gradually turned orange over the next 30 minutes. Progress of reaction was monitored by TLC and LCMS. Upon completion (formation of the PFP ester), a solution of compound 151 (0.57 g, 0.33 mmol) in DMF was added. The pH of the reaction was adjusted to pH=9-10 by addition of N,N-Diisopropylethylamine (if necessary). The reaction mixture was stirred under nitrogen for ~30 min. Upon completion, the majority of the solvent was removed under reduced pressure. The residue was diluted with $CH_2Cl_2$ and washed with aqueous saturated $NaHCO_3$, followed by brine. The organic phase separated, dried over $MgSO_4$, filtered, and concentrated to an orange syrup. The residue was purified by silica gel column chromatography (2-10% MeOH in $CH_2Cl_2$) to yield Compound 152 (0.35 g, 55%). LCMS and $^1H$ NMR were consistent with the desired product.

Compound 152 (0.35 g, 0.182 mmol) was dissolved in 1:1 MeOH/EtOAc (10 mL). The reaction mixture was purged by bubbling a stream of argon thru the solution for 15 minutes. Pearlman's catalyst (palladium hydroxide on carbon) was added (35 mg). Hydrogen gas was bubbled thru the solution for 30 minutes. Upon completion (TLC 10% MeOH in DCM, and LCMS), the catalyst was removed by filtration (syringe-tip Teflon filter, 0.45 µm). The filtrate was concentrated by rotary evaporation, and was dried briefly under high vacuum to yield Compound 153 (0.33 g, quantitative). The LCMS was consistent with desired product.

Compound 153 (0.33 g, 0.18 mmol) was dissolved in anhydrous DMF (5 mL) with stirring under nitrogen. To this N,N-Diisopropylethylamine (65 µL, 0.37 mmol) and PFP-TFA (35 µL, 0.28 mmol) were added. The reaction mixture was stirred under nitrogen for ~30 min. The reaction mixture turned magenta upon contact, and gradually turned orange. The pH of the reaction mixture was maintained at pH=9-10 by adding more N,-Diisopropylethylamine. The progress of the reaction was monitored by TLC and LCMS. Upon completion, the majority of the solvent was removed under reduced pressure. The residue was diluted with $CH_2Cl_2$ (50 mL), and washed with saturated aqueous $NaHCO_3$, followed by brine. The organic layer was dried over $MgSO_4$, filtered, and concentrated to an orange syrup. The residue was purified by column chromatography and eluted with 2-10% MeOH in $CH_2Cl_2$ to yield Compound 154 (0.29 g, 79%). LCMS and $^1H$ NMR were consistent with the desired product.

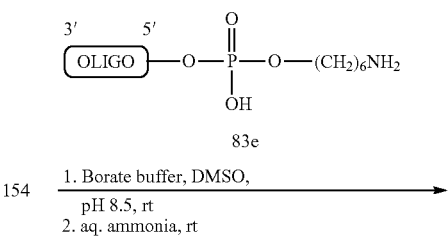

83e 154     1. Borate buffer, DMSO, pH 8.5, rt
2. aq. ammonia, rt
⟶

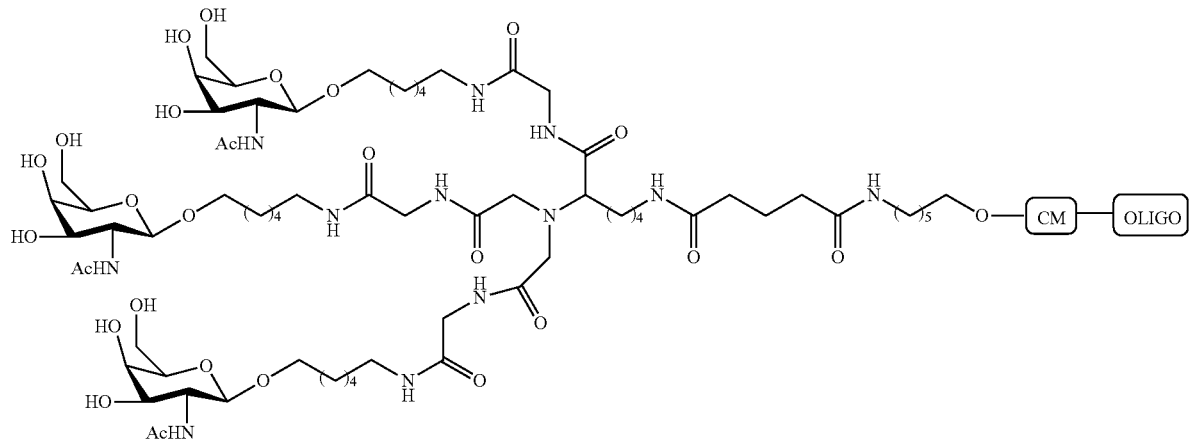

155

Oligomeric Compound 155, comprising a GalNAc$_3$-6 conjugate group, was prepared using the general procedures illustrated in Example 46. The GalNAc$_3$ cluster portion of the conjugate group GalNAc$_3$-6 (GalNAc$_3$-6$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-6 (GalNAc$_3$-6$_a$-CM-) is shown below:

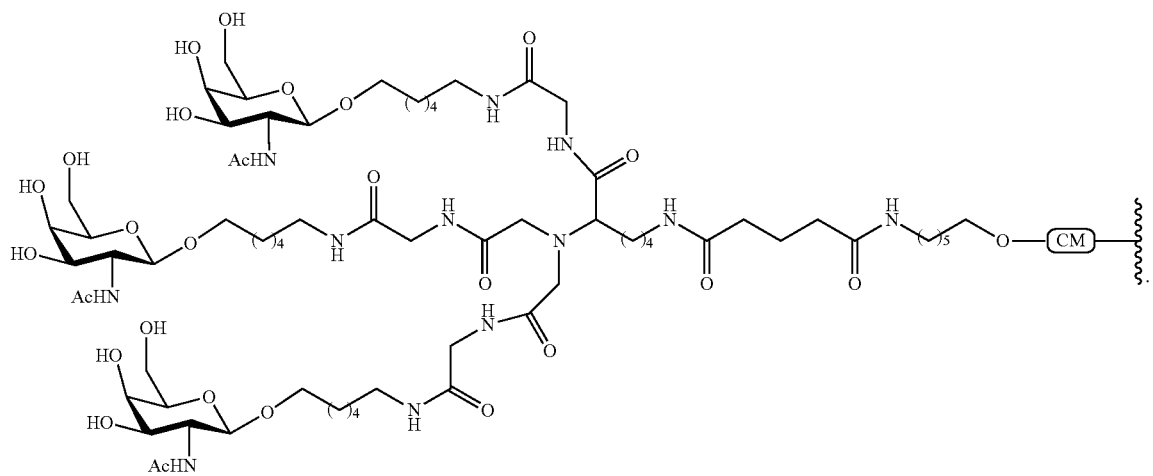

Example 52

Preparation of Oligonucleotide 160 Comprising GalNAc₃-9

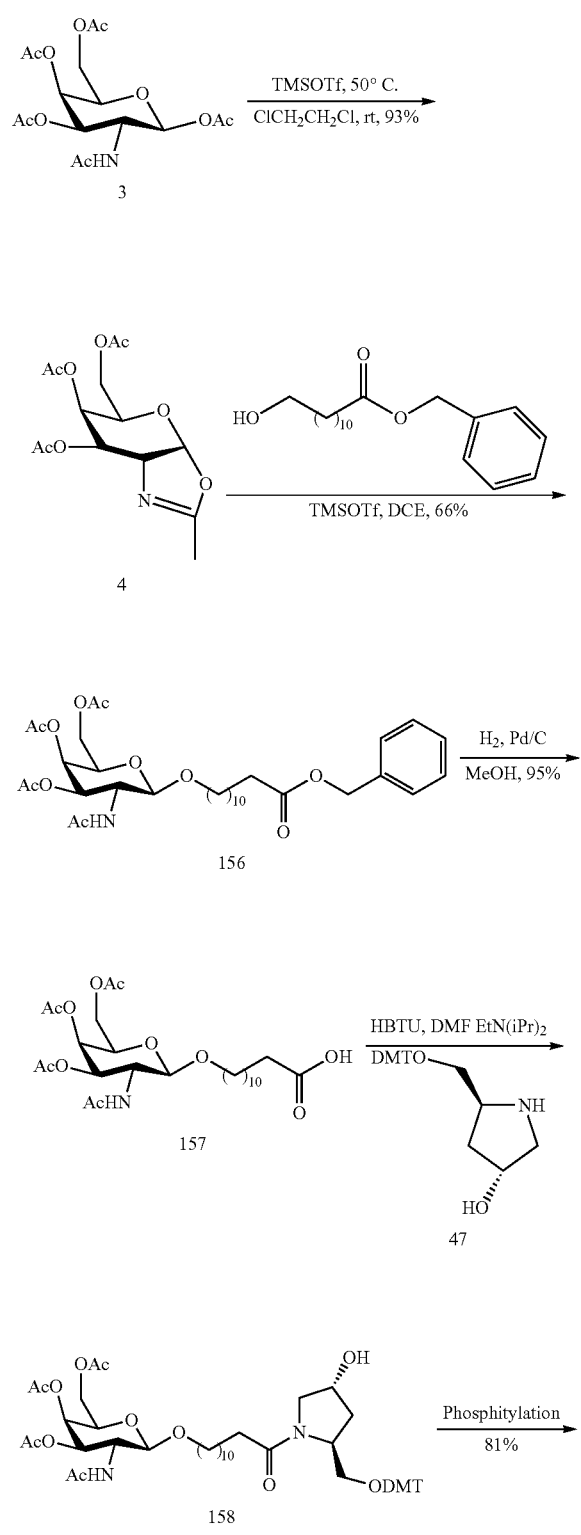

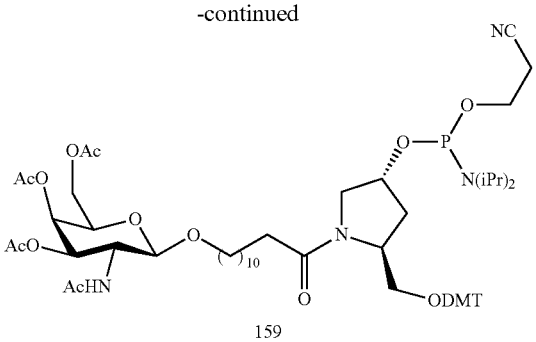

Compound 156 was synthesized following the procedure described in the literature (*J. Med. Chem.* 2004, 47, 5798-5808).

Compound 156, (18.60 g, 29.28 mmol) was dissolved in methanol (200 mL). Palladium on carbon (6.15 g, 10 wt %, loading (dry basis), matrix carbon powder, wet) was added. The reaction mixture was stirred at room temperature under hydrogen for 18 h. The reaction mixture was filtered through a pad of celite and the celite pad was washed thoroughly with methanol. The combined filtrate was washed and concentrated to dryness. The residue was purified by silica gel column chromatography and eluted with 5-10% methanol in dichloromethane to yield Compound 157 (14.26 g, 89%). Mass m/z 544.1 [M–H]⁻.

Compound 157 (5 g, 9.17 mmol) was dissolved in anhydrous DMF (30 mL). HBTU (3.65 g, 9.61 mmol) and N,N-Diisopropylethylamine (13.73 mL, 78.81 mmol) were added and the reaction mixture was stirred at room temperature for 5 minutes. To this a solution of compound 47 (2.96 g, 7.04 mmol) was added. The reaction was stirred at room temperature for 8 h. The reaction mixture was poured into a saturated NaHCO₃ aqueous solution. The mixture was extracted with ethyl acetate and the organic layer was washed with brine and dried (Na₂SO₄), filtered and evaporated. The residue obtained was purified by silica gel column chromatography and eluted with 50% ethyl acetate in hexane to yield compound 158 (8.25 g, 73.3%). The structure was confirmed by MS and ¹H NMR analysis.

Compound 158 (7.2 g, 7.61 mmol) was dried over P₂O₅ under reduced pressure. The dried compound was dissolved in anhydrous DMF (50 mL). To this 1H-tetrazole (0.43 g, 6.09 mmol) and N-methylimidazole (0.3 mL, 3.81 mmol) and 2-cyanoethyl-N,N,N',N'-tetraisopropyl phosphorodiamidite (3.65 mL, 11.50 mmol) were added. The reaction mixture was stirred t under an argon atmosphere for 4 h. The reaction mixture was diluted with ethyl acetate (200 mL). The reaction mixture was washed with saturated NaHCO₃ and brine. The organic phase was separated, dried (Na₂SO₄), filtered and evaporated. The residue was purified by silica gel column chromatography and eluted with 50-90% ethyl acetate in hexane to yield Compound 159 (7.82 g, 80.5%). The structure was confirmed by LCMS and ³¹P NMR analysis.

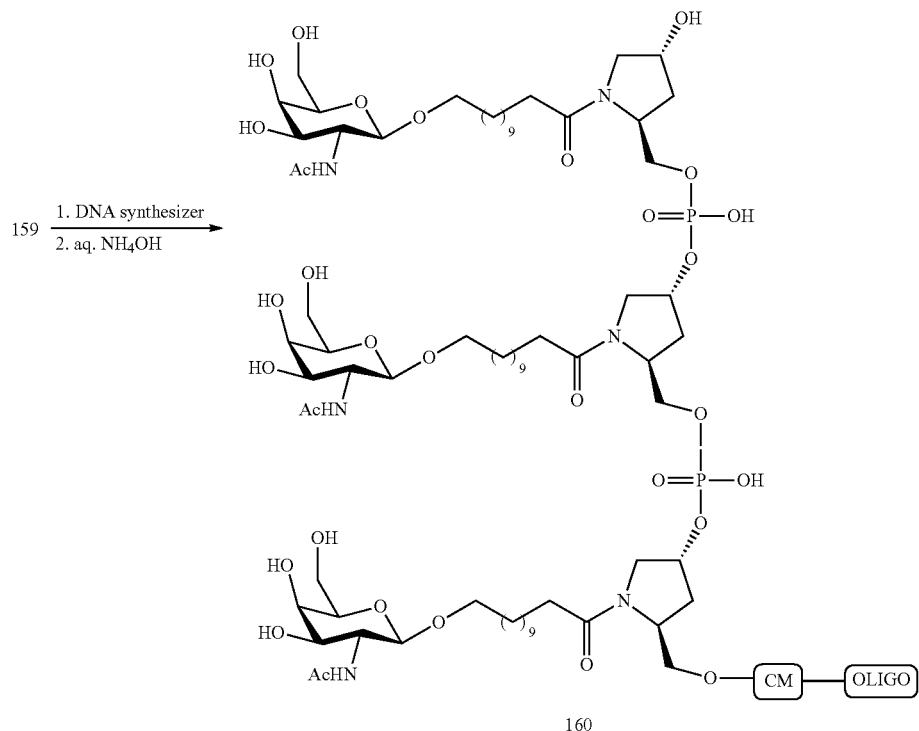

160

Oligomeric Compound 160, comprising a GalNAc$_3$-9 conjugate group, was prepared using standard oligonucleotide synthesis procedures. Three units of compound 159 were coupled to the solid support, followed by nucleotide phosphoramidites. Treatment of the protected oligomeric compound with aqueous ammonia yielded compound 160. The GalNAc$_3$ cluster portion of the conjugate group Gal-NAc$_3$-9 (GalNAc$_3$-9$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-9 (GalNAc$_3$-9$_a$-CM) is shown below:

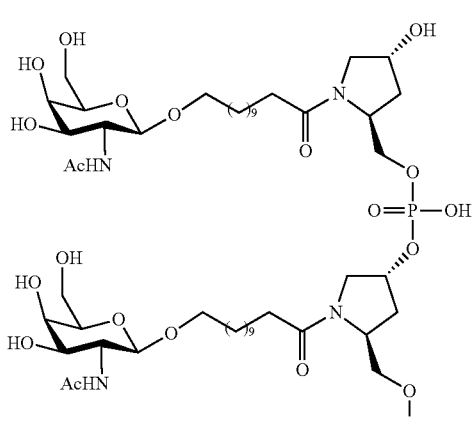

-continued

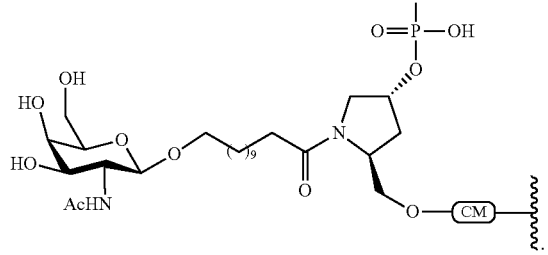

Example 53

Alternate Procedure for Preparation of Compound 18 (GalNAc$_3$-1a and GalNAc$_3$-3a)

Lactone 161 was reacted with diamino propane (3-5 eq) or Mono-Boc protected diamino propane (1 eq) to provide alcohol 162a or 162b. When unprotected propanediamine was used for the above reaction, the excess diamine was removed by evaporation under high vacuum and the free amino group in 162a was protected using CbzCl to provide 162b as a white solid after purification by column chromatography. Alcohol 162b was further reacted with compound 4 in the presence of TMSOTf to provide 163a which was converted to 163b by removal of the Cbz group using catalytic hydrogenation. The pentafluorophenyl (PFP) ester 164 was prepared by reacting triacid 113 (see Example 48) with PFPTFA (3.5 eq) and pyridine (3.5 eq) in DMF (0.1 to 0.5 M). The triester 164 was directly reacted with the amine 163b (3-4 eq) and DIPEA (3-4 eq) to provide Compound 18. The above method greatly facilitates purification of intermediates and minimizes the formation of byproducts which are formed using the procedure described in Example 4.

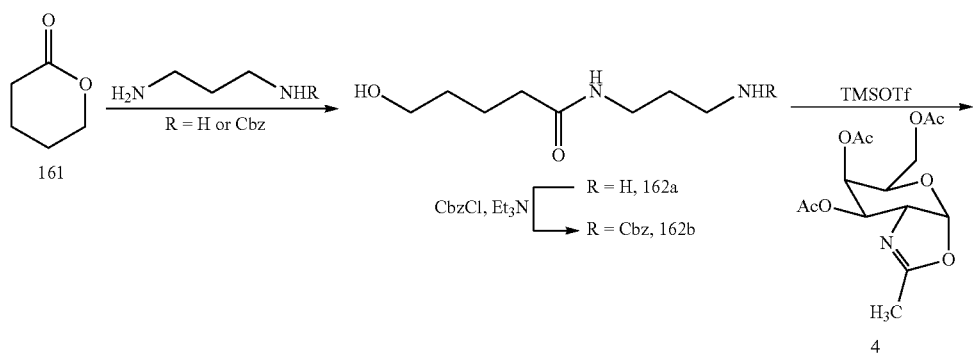

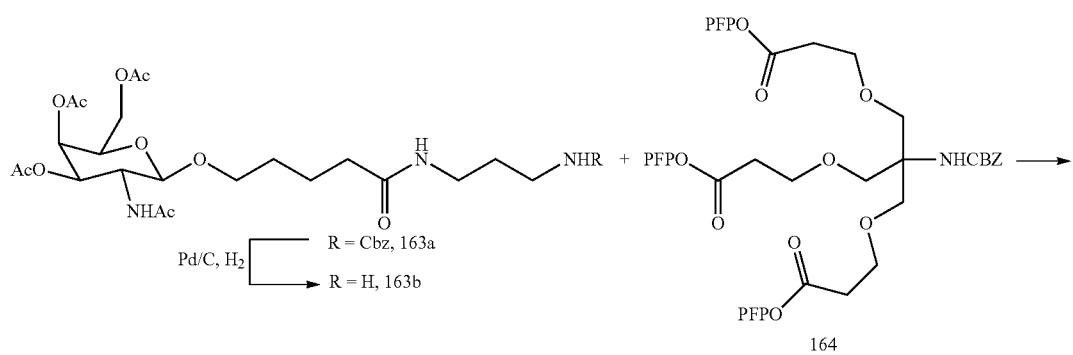

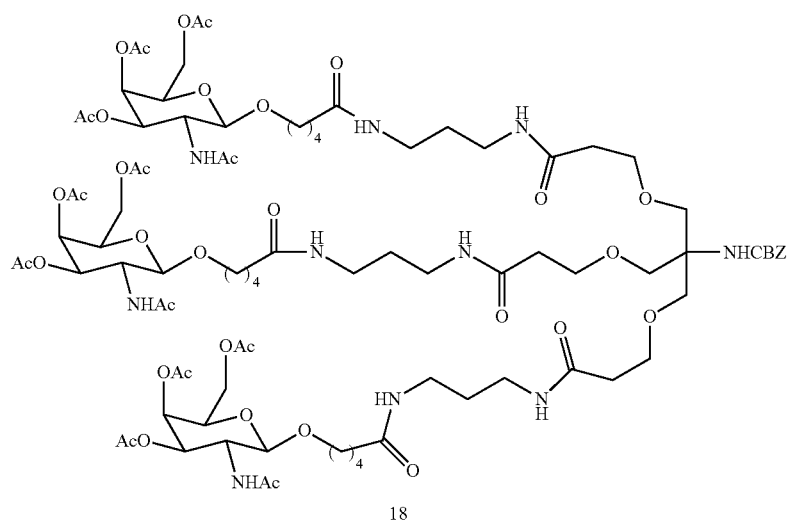

Example 54

Alternate Procedure for Preparation of Compound 18 (GalNAc₃-1a and GalNAc₃-3a)

The triPFP ester 164 was prepared from acid 113 using the procedure outlined in example 53 above and reacted with mono-Boc protected diamine to provide 165 in essentially quantitative yield. The Boc groups were removed with hydrochloric acid or trifluoroacetic acid to provide the triamine which was reacted with the PFP activated acid 166 in the presence of a suitable base such as DIPEA to provide Compound 18.

The PFP protected Gal-NAc acid 166 was prepared from the corresponding acid by treatment with PFPTFA (1-1.2 eq) and pyridine (1-1.2 eq) in DMF. The precursor acid in turn was prepared from the corresponding alcohol by oxidation using TEMPO (0.2 eq) and BAIB in acetonitrile and water. The precursor alcohol was prepared from sugar intermediate 4 by reaction with 1,6-hexanediol (or 1,5-pentanediol or other diol for other n values) (2-4 eq) and TMSOTf using conditions described previously in example 47.

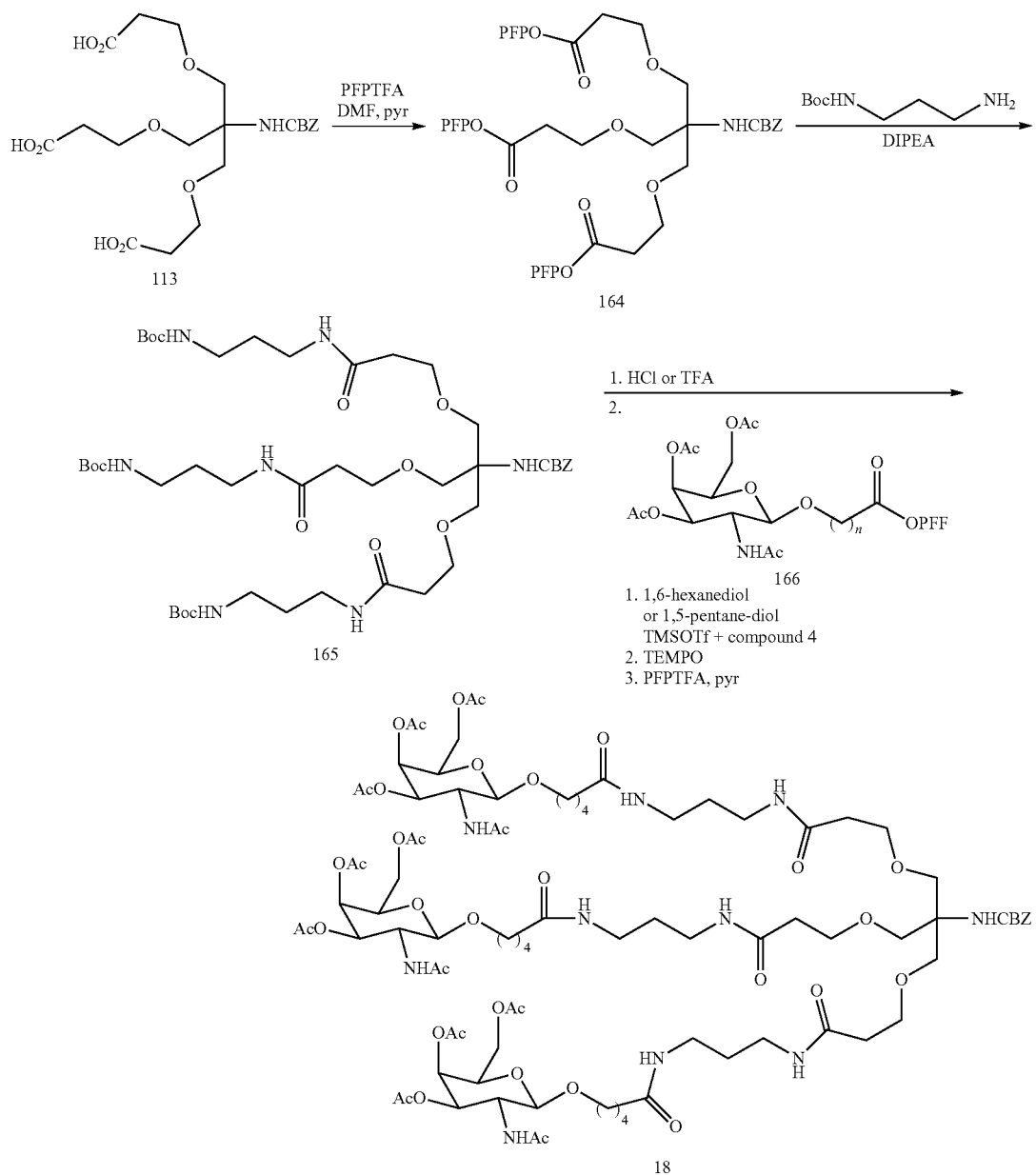

Example 55

Dose-Dependent Study of Oligonucleotides Comprising Either a 3' or 5'-Conjugate Group (Comparison of GalNAc$_3$-1, 3, 8 and 9) Targeting SRB-1 In Vivo The oligonucleotides listed below were tested in a dose-dependent study for antisense inhibition of SRB-1 in mice. Unconjugated ISIS 353382 was included as a standard. Each of the various GalNAc$_3$ conjugate groups was attached at either the 3' or 5' terminus of the respective oligonucleotide by a phosphodiester linked 2'-deoxyadenosine nucleoside (cleavable moiety).

TABLE 39

Modified ASO targeting SRB-1

| ASO | Sequence (5' to 3') | Motif | Conjugate | SEQ ID No. |
|---|---|---|---|---|
| ISIS 353382 (parent) | $G_{es}{}^mC_{es}T_{es}T_{es}{}^mC_{es}A_{ds}G_{ds}T_{ds}{}^mC_{ds}A_{ds}T_{ds}G_{ds}A_{ds}$ $^mC_{ds}T_{ds}T_{es}{}^mC_{es}{}^mC_{es}T_{es}T_e$ | 5/10/5 | none | 2304 |
| ISIS 655861 | $G_{es}{}^mC_{es}T_{es}T_{es}{}^mC_{es}A_{ds}G_{ds}T_{ds}{}^mC_{ds}A_{ds}T_{ds}G_{ds}A_{ds}$ $^mC_{ds}T_{ds}T_{es}{}^mC_{es}{}^mC_{es}T_{es}T_{eo}A_{do'}$-GalNAc$_3$-1$_a$ | 5/10/5 | GalNAc$_3$-1 | 2305 |
| ISIS 664078 | $G_{es}{}^mC_{es}T_{es}T_{es}{}^mC_{es}A_{ds}G_{ds}T_{ds}{}^mC_{ds}A_{ds}T_{ds}G_{ds}A_{ds}$ $^mC_{ds}T_{ds}T_{es}{}^mC_{es}{}^mC_{es}T_{es}T_{eo}A_{do'}$-GalNAc$_3$-9$_a$ | 5/10/5 | GalNAc$_3$-9 | 2305 |
| ISIS 661161 | GalNAc$_3$-3$_{a\text{-}o'}$A$_{do}$ $G_{es}{}^mC_{es}T_{es}T_{es}{}^mC_{es}A_{ds}G_{ds}T_{ds}{}^mC_{ds}A_{ds}T_{ds}G_{ds}A_{ds}$ $^mC_{ds}T_{ds}T_{es}{}^mC_{es}{}^mC_{es}T_{es}T_e$ | 5/10/5 | GalNAc$_3$-3 | 2304 |
| ISIS 665001 | GalNAc$_3$-8$_{a\text{-}o'}$A$_{do}$ $G_{es}{}^mC_{es}T_{es}T_{es}{}^mC_{es}A_{ds}G_{ds}T_{ds}{}^mC_{ds}A_{ds}T_{ds}G_{ds}A_{ds}$ $^mC_{ds}T_{ds}T_{es}{}^mC_{es}{}^mC_{es}T_{es}T_e$ | 5/10/5 | GalNAc$_3$-8 | 2304 |

Capital letters indicate the nucleobase for each nucleoside and $^mC$ indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9. The structure of GalNAc$_3$-9 was shown previously in Example 52. The structure of GalNAc$_3$-3 was shown previously in Example 39. The structure of GalNAc$_3$-8 was shown previously in Example 47.

Treatment

Six week old male Balb/c mice (Jackson Laboratory, Bar Harbor, Me.) were injected subcutaneously once at the dosage shown below with ISIS 353382, 655861, 664078, 661161, 665001 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 40, treatment with antisense oligonucleotides lowered SRB-1 mRNA levels in a dose-dependent manner Indeed, the antisense oligonucleotides comprising the phosphodiester linked GalNAc$_3$-1 and GalNAc$_3$-9 conjugates at the 3' terminus (ISIS 655861 and ISIS 664078) and the GalNAc$_3$-3 and GalNAc$_3$-8 conjugates linked at the 5' terminus (ISIS 661161 and ISIS 665001) showed substantial improvement in potency compared to the unconjugated antisense oligonucleotide (ISIS 353382). Furthermore, ISIS 664078, comprising a GalNAc$_3$-9 conjugate at the 3' terminus was essentially equipotent compared to ISIS 655861, which comprises a GalNAc$_3$-1 conjugate at the 3' terminus. The 5' conjugated antisense oligonucleotides, ISIS 661161 and ISIS 665001, comprising a GalNAc$_3$-3 or GalNAc$_3$-9, respectively, had increased potency compared to the 3' conjugated antisense oligonucleotides (ISIS 655861 and ISIS 664078).

TABLE 40

ASOs containing GalNAc$_3$-1,3,8 or 9 targeting SRB-1

| ISIS No. | Dosage (mg/kg) | SRB-1 mRNA (% Saline) | Conjugate |
|---|---|---|---|
| Saline | n/a | 100 | |
| 353382 | 3 | 88 | none |
| | 10 | 68 | |
| | 30 | 36 | |
| 655861 | 0.5 | 98 | GalNAc$_3$-1 (3') |
| | 1.5 | 76 | |
| | 5 | 31 | |
| | 15 | 20 | |
| 664078 | 0.5 | 88 | GalNAc$_3$-9 (3') |
| | 1.5 | 85 | |
| | 5 | 46 | |
| | 15 | 20 | |
| 661161 | 0.5 | 92 | GalNAc$_3$-3 (5') |
| | 1.5 | 59 | |
| | 5 | 19 | |
| | 15 | 11 | |
| 665001 | 0.5 | 100 | GalNAc$_3$-8 (5') |
| | 1.5 | 73 | |
| | 5 | 29 | |
| | 15 | 13 | |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in the table below.

TABLE 41

| ISIS No. | Dosage mg/kg | ALT | AST | Total Bilirubin | BUN | Conjugate |
|---|---|---|---|---|---|---|
| Saline | | 24 | 59 | 0.1 | 37.52 | |
| 353382 | 3 | 21 | 66 | 0.2 | 34.65 | none |
| | 10 | 22 | 54 | 0.2 | 34.2 | |
| | 30 | 22 | 49 | 0.2 | 33.72 | |
| 655861 | 0.5 | 25 | 62 | 0.2 | 30.65 | GalNAc$_3$-1 (3') |
| | 1.5 | 23 | 48 | 0.2 | 30.97 | |
| | 5 | 28 | 49 | 0.1 | 32.92 | |
| | 15 | 40 | 97 | 0.1 | 31.62 | |
| 664078 | 0.5 | 40 | 74 | 0.1 | 35.3 | GalNAc$_3$-9 (3') |
| | 1.5 | 47 | 104 | 0.1 | 32.75 | |
| | 5 | 20 | 43 | 0.1 | 30.62 | |
| | 15 | 38 | 92 | 0.1 | 26.2 | |

TABLE 41-continued

| ISIS No. | Dosage mg/kg | ALT | AST | Total Bilirubin | BUN | Conjugate |
|---|---|---|---|---|---|---|
| 661161 | 0.5 | 101 | 162 | 0.1 | 34.17 | GalNAc₃-3 (5') |
|  | 1.5 g | 42 | 100 | 0.1 | 33.37 |  |
|  | 5 g | 23 | 99 | 0.1 | 34.97 |  |
|  | 15 | 53 | 83 | 0.1 | 34.8 |  |
| 665001 | 0.5 | 28 | 54 | 0.1 | 31.32 | GalNAc₃-8 (5') |
|  | 1.5 | 42 | 75 | 0.1 | 32.32 |  |
|  | 5 | 24 | 42 | 0.1 | 31.85 |  |
|  | 15 | 32 | 67 | 0.1 | 31. |  |

Example 56

Dose-Dependent Study of Oligonucleotides Comprising Either a 3' or 5'-Conjugate Group (Comparison of GalNAc₃-1, 2, 3, 5, 6, 7 and 10) Targeting SRB-1 In Vivo The oligonucleotides listed below were tested in a dose-dependent study for antisense inhibition of SRB-1 in mice. Unconjugated ISIS 353382 was included as a standard. Each of the various GalNAc₃ conjugate groups was attached at the 5' terminus of the respective oligonucleotide by a phosphodiester linked 2'-deoxyadenosine nucleoside (cleavable moiety) except for ISIS 655861 which had the GalNAc₃ conjugate group attached at the 3' terminus.

GalNAc₃-6$_a$ was shown previously in Example 51. The structure of GalNAc₃-7$_a$ was shown previously in Example 48. The structure of GalNAc₃-10$_a$ was shown previously in Example 46.

Treatment

Six week old male Balb/c mice (Jackson Laboratory, Bar Harbor, Me.) were injected subcutaneously once at the dosage shown below with ISIS 353382, 655861, 664507, 661161, 666224, 666961, 666981, 666881 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 43, treatment with antisense oligonucleotides lowered SRB-1 mRNA levels in a dose-dependent manner. Indeed, the conjugated antisense oligonucleotides showed substantial improvement in potency compared to the unconjugated antisense oligonucleotide (ISIS 353382). The 5' conjugated antisense oligonucleotides showed a slight increase in potency compared to the 3' conjugated antisense oligonucleotide.

TABLE 42

Modified ASO targeting SRB-1

| ASO | Sequence (5' to 3') | Motif | Conjugate | SEQ ID No. |
|---|---|---|---|---|
| ISIS 353382 (parent) | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$T$_{es}$T$_{e}$ | 5/10/5 | no conjugate | 2304 |
| ISIS 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$T$_{es}$T$_{eo}$A$_{do'}$-GalNAc₃-1$_a$ | 5/10/5 | GalNAc₃-1 | 2305 |
| ISIS 664507 | GalNAc₃-2$_a$-$_{o'}$A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc₃-2 | 2306 |
| ISIS 661161 | GalNAc₃-3$_a$-$_{o'}$A$_{do}$ G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$T$_{es}$T$_{e}$ | 5/10/5 | GalNAc₃-3 | 2304 |
| ISIS 666224 | GalNAc₃-5$_a$-$_{o'}$A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc₃-5 | 2306 |
| ISIS 666961 | GalNAc₃-6$_a$-$_{o'}$A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc₃-6 | 2306 |
| ISIS 666981 | GalNAc₃-7$_a$-$_{o'}$A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc₃-7 | 2306 |
| ISIS 666881 | GalNAc₃-10$_a$-$_{o'}$A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | 5/10/5 | GalNAc₃-10 | 2306 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc₃-1$_a$ was shown previously in Example 9. The structure of GalNAc₃-2$_a$ was shown previously in Example 37. The structure of GalNAc₃-3$_a$ was shown previously in Example 39. The structure of GalNAc₃-5$_a$ was shown previously in Example 49. The structure of

TABLE 43

| ISIS No. | Dosage (mg/kg) | SRB-1 mRNA (% Saline) | Conjugate |
|---|---|---|---|
| Saline | n/a | 100.0 |  |
| 353382 | 3 | 96.0 | none |
|  | 10 | 73.1 |  |
|  | 30 | 36.1 |  |
| 655861 | 0.5 | 99.4 | GalNAc₃-1 (3') |
|  | 1.5 | 81.2 |  |
|  | 5 | 33.9 |  |
|  | 15 | 15.2 |  |

TABLE 43-continued

| ISIS No. | Dosage (mg/kg) | SRB-1 mRNA (% Saline) | Conjugate |
|---|---|---|---|
| 664507 | 0.5 | 102.0 | GalNAc$_3$-2 (5') |
|  | 1.5 | 73.2 |  |
|  | 5 | 31.3 |  |
|  | 15 | 10.8 |  |
| 661161 | 0.5 | 90.7 | GalNAc$_3$-3 (5') |
|  | 1.5 | 67.6 |  |
|  | 5 | 24.3 |  |
|  | 15 | 11.5 |  |
| 666224 | 0.5 | 96.1 | GalNAc$_3$-5 (5') |
|  | 1.5 | 61.6 |  |
|  | 5 | 25.6 |  |
|  | 15 | 11.7 |  |
| 666961 | 0.5 | 85.5 | GalNAc$_3$-6 (5') |
|  | 1.5 | 56.3 |  |
|  | 5 | 34.2 |  |
|  | 15 | 13.1 |  |
| 666981 | 0.5 | 84.7 | GalNAc$_3$-7 (5') |
|  | 1.5 | 59.9 |  |
|  | 5 | 24.9 |  |
|  | 15 | 8.5 |  |
| 666881 | 0.5 | 100.0 | GalNAc$_3$-10 (5') |
|  | 1.5 | 65.8 |  |
|  | 5 | 26.0 |  |
|  | 15 | 13.0 |  |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in Table 44 below.

TABLE 44

| ISIS No. | Dosage mg/kg | ALT | AST | Total Bilirubin | BUN | Conjugate |
|---|---|---|---|---|---|---|
| Saline |  | 26 | 57 | 0.2 | 27 |  |
| 353382 | 3 | 25 | 92 | 0.2 | 27 | none |
|  | 10 | 23 | 40 | 0.2 | 25 |  |
|  | 30 | 29 | 54 | 0.1 | 28 |  |
| 655861 | 0.5 | 25 | 71 | 0.2 | 34 | GalNAc$_3$-1 (3') |
|  | 1.5 | 28 | 60 | 0.2 | 26 |  |
|  | 5 | 26 | 63 | 0.2 | 28 |  |
|  | 15 | 25 | 61 | 0.2 | 28 |  |
| 664507 | 0.5 | 25 | 62 | 0.2 | 25 | GalNAc$_3$-2 (5') |
|  | 1.5 | 24 | 49 | 0.2 | 26 |  |
|  | 5 | 21 | 50 | 0.2 | 26 |  |
|  | 15 | 59 | 84 | 0.1 | 22 |  |
| 661161 | 0.5 | 20 | 42 | 0.2 | 29 | GalNAc$_3$-3 (5') |
|  | 1.5 g | 37 | 74 | 0.2 | 25 |  |
|  | 5 g | 28 | 61 | 0.2 | 29 |  |
|  | 15 | 21 | 41 | 0.2 | 25 |  |
| 666224 | 0.5 | 34 | 48 | 0.2 | 21 | GalNAc$_3$-5 (5') |
|  | 1.5 | 23 | 46 | 0.2 | 26 |  |
|  | 5 | 24 | 47 | 0.2 | 23 |  |
|  | 15 | 32 | 49 | 0.1 | 26 |  |
| 666961 | 0.5 | 17 | 63 | 0.2 | 26 | GalNAc$_3$-6 (5') |
|  | 1.5 | 23 | 68 | 0.2 | 26 |  |
|  | 5 | 25 | 66 | 0.2 | 26 |  |
|  | 15 | 29 | 107 | 0.2 | 28 |  |
| 666981 | 0.5 | 24 | 48 | 0.2 | 26 | GalNAc$_3$-7 (5') |
|  | 1.5 | 30 | 55 | 0.2 | 24 |  |
|  | 5 | 46 | 74 | 0.1 | 24 |  |
|  | 15 | 29 | 58 | 0.1 | 26 |  |
| 666881 | 0.5 | 20 | 65 | 0.2 | 27 | GalNAc$_3$-10 (5') |
|  | 1.5 | 23 | 59 | 0.2 | 24 |  |
|  | 5 | 45 | 70 | 0.2 | 26 |  |
|  | 15 | 21 | 57 | 0.2 | 24 |  |

Example 57

Duration of Action Study of Oligonucleotides Comprising a 3'-Conjugate Group Targeting ApoC III In Vivo Mice were injected once with the doses indicated below and monitored over the course of 42 days for ApoC-III and plasma triglycerides (Plasma TG) levels. The study was performed using 3 transgenic mice that express human APOC-III in each group.

TABLE 45

Modified ASO targeting ApoC III

| ASO | Sequence (5' to 3') | Linkages | SEQ ID No. |
|---|---|---|---|
| ISIS 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | PS | 2296 |
| ISIS 647535 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_{eo}$A$_{do'}$-GalNAc$_3$-1$_a$ | PS | 2297 |
| ISIS 647536 | A$_{es}$G$_{eo}$$^m$C$_{eo}$T$_{eo}$T$_{eo}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{eo}$T$_{eo}$T$_{es}$A$_{es}$T$_{eo}$A$_{do'}$-GalNAc$_3$-1$_a$ | PO/PS | 2297 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(═O)(OH)—. Conjugate groups are in bold.

The structure of GalNAc$_3$-1$_a$ was shown previously in Example 9.

TABLE 46

ApoC III mRNA (% Saline on Day 1) and Plasma TG Levels (% Saline on Day 1)

| ASO | Dose | Target | Day 3 | Day 7 | Day 14 | Day 35 | Day 42 |
|---|---|---|---|---|---|---|---|
| Saline | 0 mg/kg | ApoC-III | 98 | 100 | 100 | 95 | 116 |
| ISIS 304801 | 30 mg/kg | ApoC-III | 28 | 30 | 41 | 65 | 74 |
| ISIS 647535 | 10 mg/kg | ApoC-III | 16 | 19 | 25 | 74 | 94 |
| ISIS 647536 | 10 mg/kg | ApoC-III | 18 | 16 | 17 | 35 | 51 |
| Saline | 0 mg/kg | Plasma TG | 121 | 130 | 123 | 105 | 109 |
| ISIS 304801 | 30 mg/kg | Plasma TG | 34 | 37 | 50 | 69 | 69 |
| ISIS 647535 | 10 mg/kg | Plasma TG | 18 | 14 | 24 | 18 | 71 |
| ISIS 647536 | 10 mg/kg | Plasma TG | 21 | 19 | 15 | 32 | 35 |

As can be seen in the table above the duration of action increased with addition of the 3'-conjugate group compared to the unconjugated oligonucleotide. There was a further increase in the duration of action for the conjugated mixed PO/PS oligonucleotide 647536 as compared to the conjugated full PS oligonucleotide 647535.

Example 58

Dose-Dependent Study of Oligonucleotides Comprising a 3'-Conjugate Group (Comparison of GalNAc$_3$-1 and GalNAc$_4$-11) Targeting SRB-1 In Vivo The oligonucleotides listed below were tested in a dose-dependent study for antisense inhibition of SRB-1 in mice. Unconjugated ISIS 440762 was included as an unconjugated standard. Each of the conjugate groups were attached at the 3' terminus of the respective oligonucleotide by a phosphodiester linked 2'-deoxyadenosine nucleoside cleavable moiety.

The structure of GalNAc$_3$-1$_a$ was shown previously in Example 9. The structure of GalNAc$_3$-11$_a$ was shown previously in Example 50.

Treatment

Six week old male Balb/c mice (Jackson Laboratory, Bar Harbor, Me.) were injected subcutaneously once at the dosage shown below with ISIS 440762, 651900, 663748 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 47, treatment with antisense oligonucleotides lowered SRB-1 mRNA levels in a dose-dependent manner. The antisense oligonucleotides comprising the phosphodiester linked GalNAc$_3$-1 and GalNAc$_4$-11 conjugates at the 3' terminus (ISIS 651900 and ISIS 663748) showed substantial improvement in potency compared to the unconjugated antisense oligonucleotide (ISIS 440762). The two conjugated oligonucleotides, GalNAc$_3$-1 and GalNAc$_4$-11, were equipotent.

TABLE 47

Modified ASO targeting SRB-1

| ASO | Sequence (5' to 3') | Dose mg/kg | % Saline control | SEQ ID No. |
|---|---|---|---|---|
| Saline | | | 100 | |
| ISIS 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{ks}$$^m$C$_k$ | 0.6 | 73.45 | 2298 |
| | | 2 | 59.66 | |
| | | 6 | 23.50 | |
| ISIS 651900 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{ks}$$^m$C$_{ko}$A$_{do}$'-GalNAc$_3$-1$_a$ | 0.2 | 62.75 | 2299 |
| | | 0.6 | 29.14 | |
| | | 2 | 8.61 | |
| | | 6 | 5.62 | |
| ISIS 663748 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{ks}$$^m$C$_{ko}$A$_{do}$'-GalNAc$_4$-11$_a$ | 0.2 | 63.99 | 2299 |
| | | 0.6 | 33.53 | |
| | | 2 | 7.58 | |
| | | 6 | 5.52 | |

Capital letters indicate the nucleobase for each nucleoside and $^m$C indicates a 5-methyl cytosine. Subscripts: "e" indicates a 2'-MOE modified nucleoside; "k" indicates 6'-(S)—CH$_3$ bicyclic nucleoside; "d" indicates β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in Table 48 below.

TABLE 48

| ISIS No. | Dosage mg/kg | ALT | AST | Total Bilirubin | BUN | Conjugate |
|---|---|---|---|---|---|---|
| Saline |  | 30 | 76 | 0.2 | 40 |  |
| 440762 | 0.60 | 32 | 70 | 0.1 | 35 | none |
|  | 2 | 26 | 57 | 0.1 | 35 |  |
|  | 6 | 31 | 48 | 0.1 | 39 |  |
| 651900 | 0.2 | 32 | 115 | 0.2 | 39 | GalNAc$_3$-1 (3') |
|  | 0.6 | 33 | 61 | 0.1 | 35 |  |
|  | 2 | 30 | 50 | 0.1 | 37 |  |
|  | 6 | 34 | 52 | 0.1 | 36 |  |
| 663748 | 0.2 | 28 | 56 | 0.2 | 36 | GalNAc$_4$-11 (3') |
|  | 0.6 | 34 | 60 | 0.1 | 35 |  |
|  | 2 | 44 | 62 | 0.1 | 36 |  |
|  | 6 | 38 | 71 | 0.1 | 33 |  |

Example 59

Effects of GalNAc$_3$-1 Conjugated ASOs Targeting FXI In Vivo

The oligonucleotides listed below were tested in a multiple dose study for antisense inhibition of FXI in mice. ISIS 404071 was included as an unconjugated standard. Each of the conjugate groups was attached at the 3' terminus of the respective oligonucleotide by a phosphodiester linked 2'-deoxyadenosine nucleoside cleavable moiety.

TABLE 49

Modified ASOs targeting FXI

| ASO | Sequence (5' to 3') | Linkages | SEQ ID No. |
|---|---|---|---|
| ISIS 404071 | T$_{es}$G$_{es}$G$_{es}$T$_{es}$A$_{es}$A$_{ds}$T$_{ds}$$^m$C$_{ds}$$^m$C$_{ds}$A$_{ds}$$^m$C$_{ds}$ T$_{ds}$T$_{ds}$T$_{ds}$$^m$C$_{ds}$A$_{es}$G$_{es}$A$_{es}$G$_{es}$G$_{e}$ | PS | 2307 |
| ISIS 656172 | T$_{es}$G$_{es}$G$_{es}$T$_{es}$A$_{es}$A$_{ds}$T$_{ds}$$^m$C$_{ds}$$^m$C$_{ds}$A$_{ds}$$^m$C$_{ds}$ T$_{ds}$T$_{ds}$T$_{ds}$$^m$C$_{ds}$A$_{es}$G$_{es}$A$_{es}$G$_{es}$G$_{eo}$A$_{do'}$-GalNAc$_3$-1$_a$ | PS | 2308 |
| ISIS 656173 | T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$ T$_{ds}$T$_{ds}$T$_{ds}$$^m$C$_{ds}$A$_{eo}$G$_{eo}$A$_{es}$G$_{es}$G$_{eo}$A$_{do'}$-GalNAc$_3$-1$_a$ | PO/PS | 2308 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9.

Treatment

Six week old male Balb/c mice (Jackson Laboratory, Bar Harbor, Me.) were injected subcutaneously twice a week for 3 weeks at the dosage shown below with ISIS 404071, 656172, 656173 or with PBS treated control. Each treatment group consisted of 4 animals. The mice were sacrificed 72 hours following the final administration to determine the liver FXI mRNA levels using real-time PCR and RIBOGREEN® RNA quantification reagent (Molecular Probes, Inc. Eugene, Oreg.) according to standard protocols. Plasma FXI protein levels were also measured using ELISA. FXI mRNA levels were determined relative to total RNA (using RIBOGREEN®), prior to normalization to PBS-treated control. The results below are presented as the average percent of FXI mRNA levels for each treatment group. The data was normalized to PBS-treated control and is denoted as "% PBS". The ED$_{50}$s were measured using similar methods as described previously and are presented below.

TABLE 50

Factor XI mRNA (% Saline)

| ASO | Dose mg/kg | % Control | Conjugate | Linkages |
|---|---|---|---|---|
| Saline |  | 100 | none |  |
| ISIS 404071 | 3 | 92 | none | PS |
|  | 10 | 40 |  |  |
|  | 30 | 15 |  |  |
| ISIS 656172 | 0.7 | 74 | GalNAc$_3$-1 | PS |
|  | 2 | 33 |  |  |
|  | 6 | 9 |  |  |
| ISIS 656173 | 0.7 | 49 | GalNAc$_3$-1 | PO/PS |
|  | 2 | 22 |  |  |
|  | 6 | 1 |  |  |

As illustrated in Table 50, treatment with antisense oligonucleotides lowered FXI mRNA levels in a dose-dependent manner. The oligonucleotides comprising a 3'-GalNAc$_3$-1 conjugate group showed substantial improvement in potency compared to the unconjugated antisense oligonucleotide (ISIS 404071). Between the two conjugated oligonucleotides an improvement in potency was further provided by substituting some of the PS linkages with PO (ISIS 656173).

As illustrated in Table 50a, treatment with antisense oligonucleotides lowered FXI protein levels in a dose-dependent manner. The oligonucleotides comprising a 3'-GalNAc$_3$-1 conjugate group showed substantial improvement in potency compared to the unconjugated antisense oligonucleotide (ISIS 404071). Between the two conjugated oligonucleotides an improvement in potency was further provided by substituting some of the PS linkages with PO (ISIS 656173).

TABLE 50a

Factor XI protein (% Saline)

| ASO | Dose mg/kg | Protein (% Control) | Conjugate | Linkages |
|---|---|---|---|---|
| Saline |  | 100 | none |  |
| ISIS 404071 | 3 | 127 | none | PS |
|  | 10 | 32 |  |  |
|  | 30 | 3 |  |  |

TABLE 50a-continued

| ASO | Dose mg/kg | Protein (% Control) | Conjugate | Linkages |
|---|---|---|---|---|
| ISIS 656172 | 0.7 | 70 | GalNAc$_3$-1 | PS |
|  | 2 | 23 |  |  |
|  | 6 | 1 |  |  |
| ISIS 656173 | 0.7 | 45 | GalNAc$_3$-1 | PO/PS |
|  | 2 | 6 |  |  |
|  | 6 | 0 |  |  |

Liver transaminase levels, alanine aminotransferase (ALT) and aspartate aminotransferase (AST), in serum were measured relative to saline injected mice using standard protocols. Total bilirubin, total albumin, CRE and BUN were also evaluated. The change in body weights was evaluated with no significant change from the saline group. ALTs, ASTs, total bilirubin and BUN values are shown in the table below.

TABLE 51

| ISIS No. | Dosage mg/kg | ALT | AST | Total Albumin | Total Bilirubin | CRE | BUN | Conjugate |
|---|---|---|---|---|---|---|---|---|
| Saline |  | 71.8 | 84.0 | 3.1 | 0.2 | 0.2 | 22.9 |  |
| 404071 | 3 | 152.8 | 176.0 | 3.1 | 0.3 | 0.2 | 23.0 | none |
|  | 10 | 73.3 | 121.5 | 3.0 | 0.2 | 0.2 | 21.4 |  |
|  | 30 | 82.5 | 92.3 | 3.0 | 0.2 | 0.2 | 23.0 |  |
| 656172 | 0.7 | 62.5 | 111.5 | 3.1 | 0.2 | 0.2 | 23.8 | GalNAc$_3$-1 |
|  | 2 | 33.0 | 51.8 | 2.9 | 0.2 | 0.2 | 22.0 | (3') |
|  | 6 | 65.0 | 71.5 | 3.2 | 0.2 | 0.2 | 23.9 |  |
| 656173 | 0.7 | 54.8 | 90.5 | 3.0 | 0.2 | 0.2 | 24.9 | GalNAc$_3$-1 |
|  | 2 | 85.8 | 71.5 | 3.2 | 0.2 | 0.2 | 21.0 | (3') |
|  | 6 | 114.0 | 101.8 | 3.3 | 0.2 | 0.2 | 22.7 |  |

Example 60

Effects of Conjugated ASOs Targeting SRB-1 In Vitro

The oligonucleotides listed below were tested in a multiple dose study for antisense inhibition of SRB-1 in primary mouse hepatocytes. ISIS 353382 was included as an unconjugated standard. Each of the conjugate groups were attached at the 3' or 5' terminus of the respective oligonucleotide by a phosphodiester linked 2'-deoxyadenosine nucleoside cleavable moiety.

TABLE 52

Modified ASO targeting SRB-1

| ASO | Sequence (5' to 3') | Motif | Conjugate | SEQ ID No. |
|---|---|---|---|---|
| ISIS 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$T$_{es}$T$_e$ | 5/10/5 | none | 2304 |
| ISIS 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$T$_{es}$T$_{eo}$A$_{do}$,-GalNAc$_3$-1a | 5/10/5 | GalNAc$_3$-1 | 2305 |
| ISIS 655862 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{eo}$$^m$C$_{es}$T$_{es}$T$_{eo}$A$_{do}$,-GalNAc$_3$-1a | 5/10/5 | GalNAc$_3$-1 | 2305 |
| ISIS 661161 | GalNAc$_3$-3$_{a-o}$,A$_{do}$G$_{es}$$^m$C$_{es}$T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-3 | 2306 |
| ISIS 665001 | GalNAc$_3$-8$_{a-o}$,A$_{do}$G$_{es}$$^m$C$_{es}$T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-8 | 2306 |
| ISIS 664078 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$T$_{es}$T$_{eo}$A$_{do}$,-GalNAc$_3$-9$_a$ | 5/10/5 | GalNAc$_3$-9 | 2305 |
| ISIS 666961 | GalNAc$_3$-6$_{a-o}$,A$_{do}$G$_{es}$$^m$C$_{es}$T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-6 | 2306 |

TABLE 52-continued

Modified ASO targeting SRB-1

| ASO | Sequence (5' to 3') | Motif Conjugate | SEQ ID No. |
|---|---|---|---|
| ISIS 664507 | GalNAc$_3$-2$_a$-$_o$,A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 GalNAc$_3$-2 | 2306 |
| ISIS 666881 | GalNAc$_3$-10$_a$-$_o$,A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 GalNAc$_3$-10 | 2306 |
| ISIS 666224 | GalNAc$_3$-5$_a$-$_o$,A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 GalNAc$_3$-5 | 2306 |
| ISIS 666981 | GalNAc$_3$-7$_a$-$_o$,A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 GalNAc$_3$-7 | 2306 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9. The structure of GalNAc$_3$-3a was shown previously in Example 39. The structure of GalNAc$_3$-8a was shown previously in Example 47. The structure of GalNAc$_3$-9a was shown previously in Example 52. The structure of GalNAc$_3$-6a was shown previously in Example 51. The structure of GalNAc$_3$-2a was shown previously in Example 37. The structure of GalNAc$_3$-10a was shown previously in Example 46. The structure of GalNAc$_3$-5a was shown previously in Example 49. The structure of GalNAc$_3$-7a was shown previously in Example 48.

Treatment

The oligonucleotides listed above were tested in vitro in primary mouse hepatocyte cells plated at a density of 25,000 cells per well and treated with 0.03, 0.08, 0.24, 0.74, 2.22, 6.67 or 20 nM modified oligonucleotide. After a treatment period of approximately 16 hours, RNA was isolated from the cells and mRNA levels were measured by quantitative real-time PCR and the SRB-1 mRNA levels were adjusted according to total RNA content, as measured by RIBOGREEN®.

The IC$_{50}$ was calculated using standard methods and the results are presented in Table 53. The results show that, under free uptake conditions in which no reagents or electroporation techniques are used to artificially promote entry of the oligonucleotides into cells, the oligonucleotides comprising a GalNAc conjugate were significantly more potent in hepatocytes than the parent oligonucleotide (ISIS 353382) that does not comprise a GalNAc conjugate.

TABLE 53

| ASO | IC$_{50}$ (nM) | Internucleoside linkages | Conjugate | SEQ ID No. |
|---|---|---|---|---|
| ISIS 353382 | 190$^a$ | PS | none | 2304 |
| ISIS 655861 | 11$^a$ | PS | GalNAc$_3$-1 | 2305 |
| ISIS 655862 | 3 | PO/PS | GalNAc$_3$-1 | 2305 |
| ISIS 661161 | 15$^a$ | PS | GalNAc$_3$-3 | 2306 |
| ISIS 665001 | 20 | PS | GalNAc$_3$-8 | 2306 |
| ISIS 664078 | 55 | PS | GalNAc$_3$-9 | 2305 |
| ISIS 666961 | 22$^a$ | PS | GalNAc$_3$-6 | 2306 |
| ISIS 664507 | 30 | PS | GalNAc$_3$-2 | 2306 |
| ISIS 666881 | 30 | PS | GalNAc$_3$-10 | 2306 |
| ISIS 666224 | 30$^a$ | PS | GalNAc$_3$-5 | 2306 |
| ISIS 666981 | 40 | PS | GalNAc$_3$-7 | 2306 |

$^a$Average of multiple runs.

Example 61

Preparation of Oligomeric Compound 175 Comprising GalNAc$_3$-12

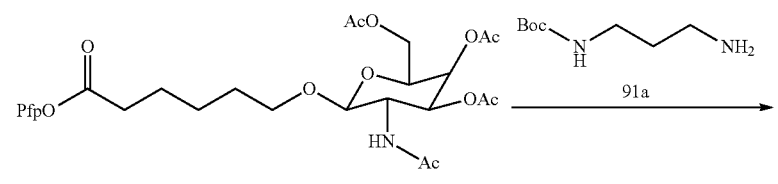

166

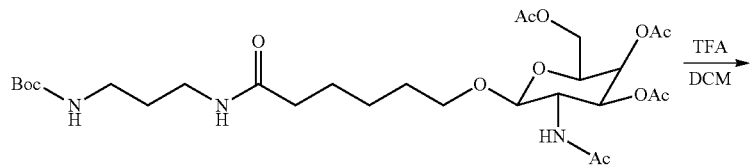

167

-continued
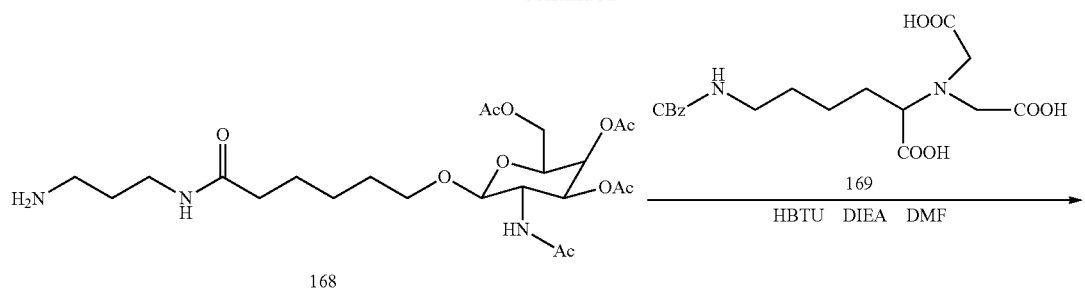
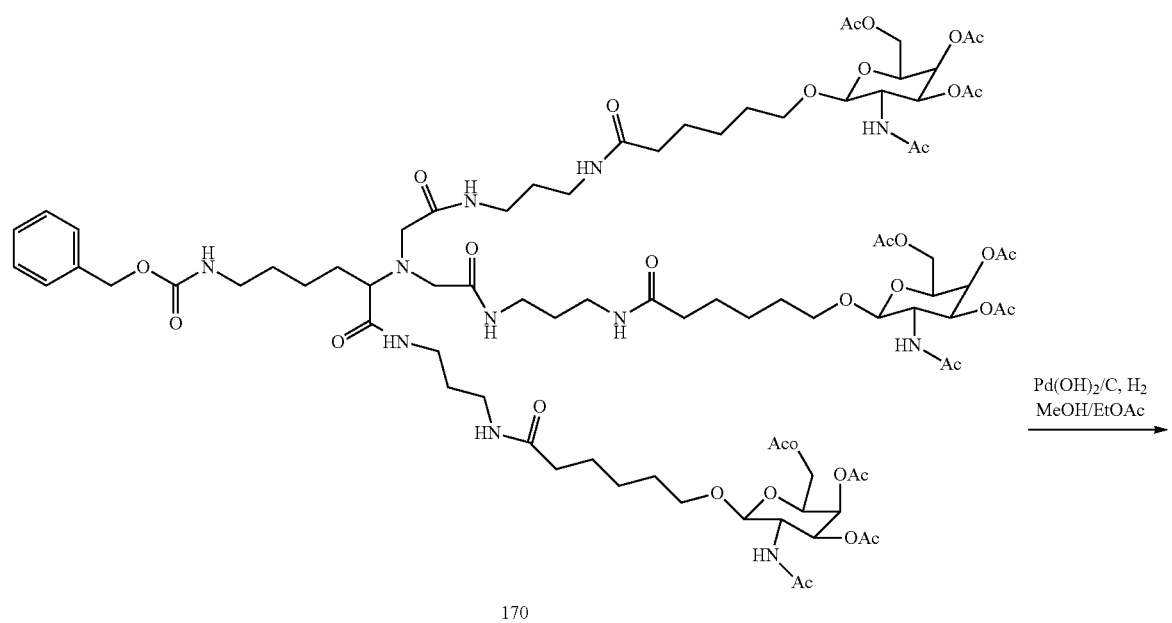
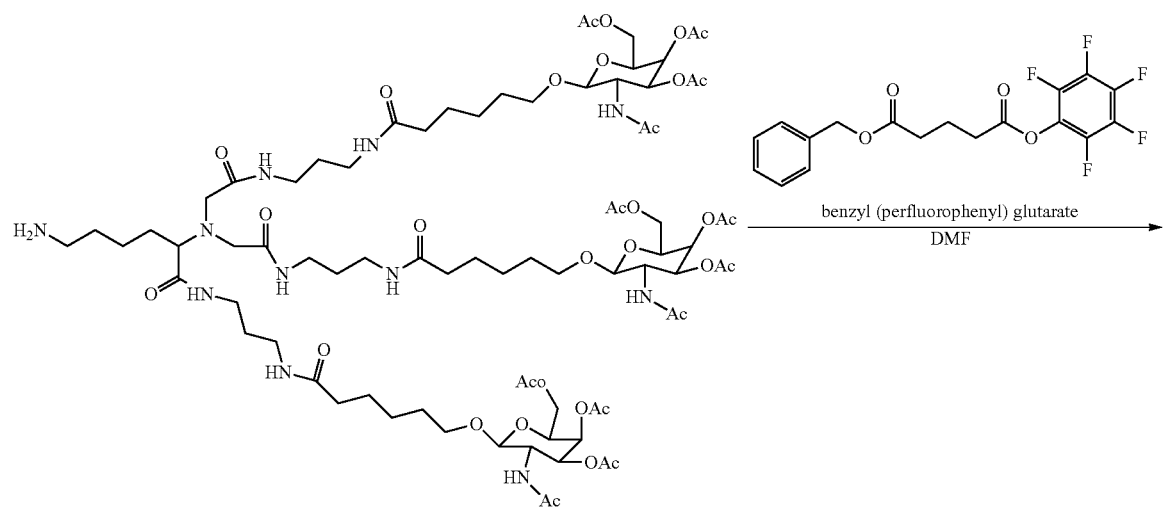

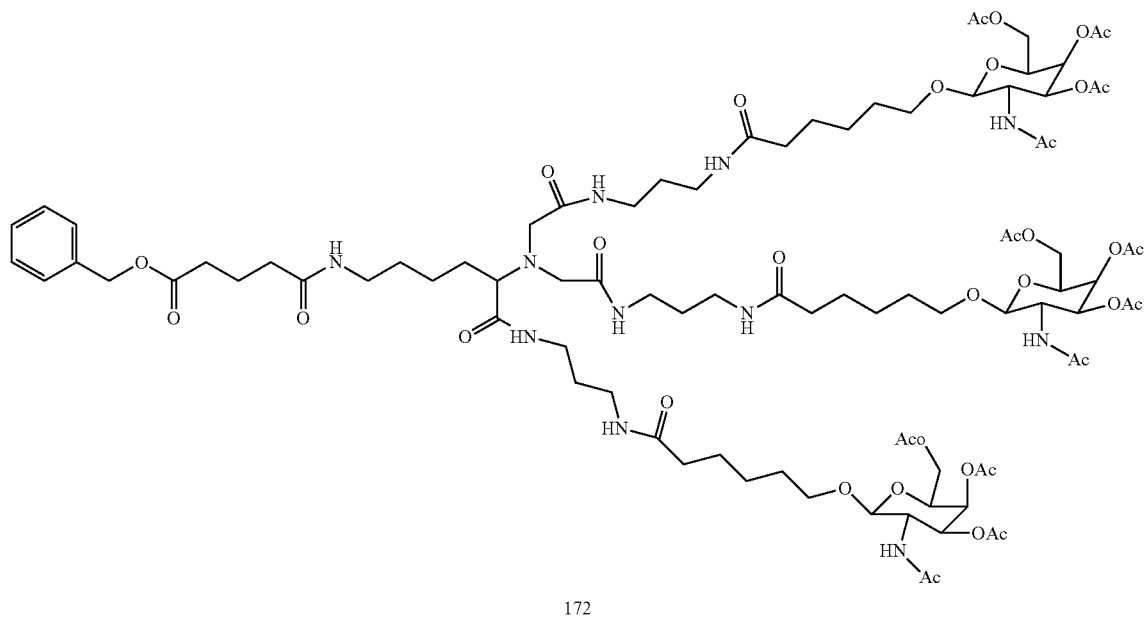
172
172 →[Pd(OH)₂/C, H₂; MeOH/EtOAc]
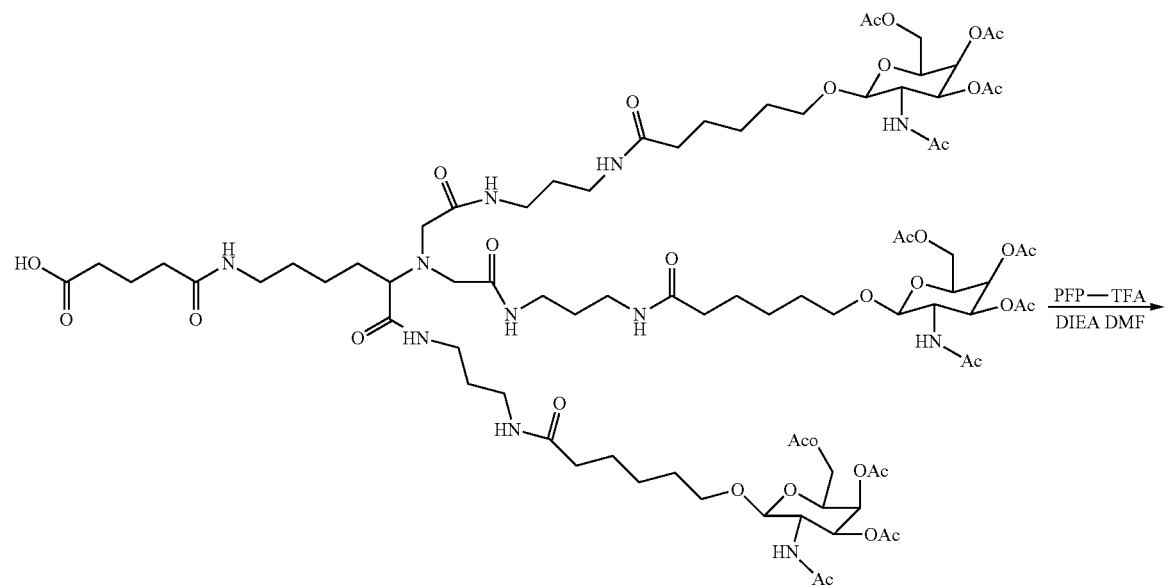
173 →[PFP—TFA; DIEA DMF]

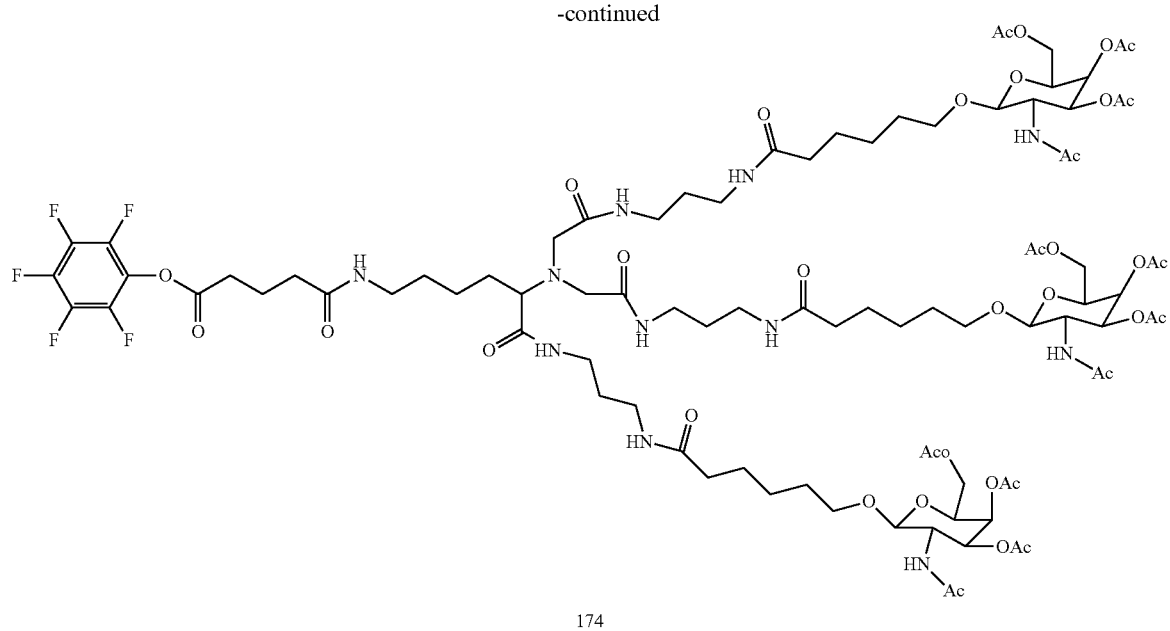

174

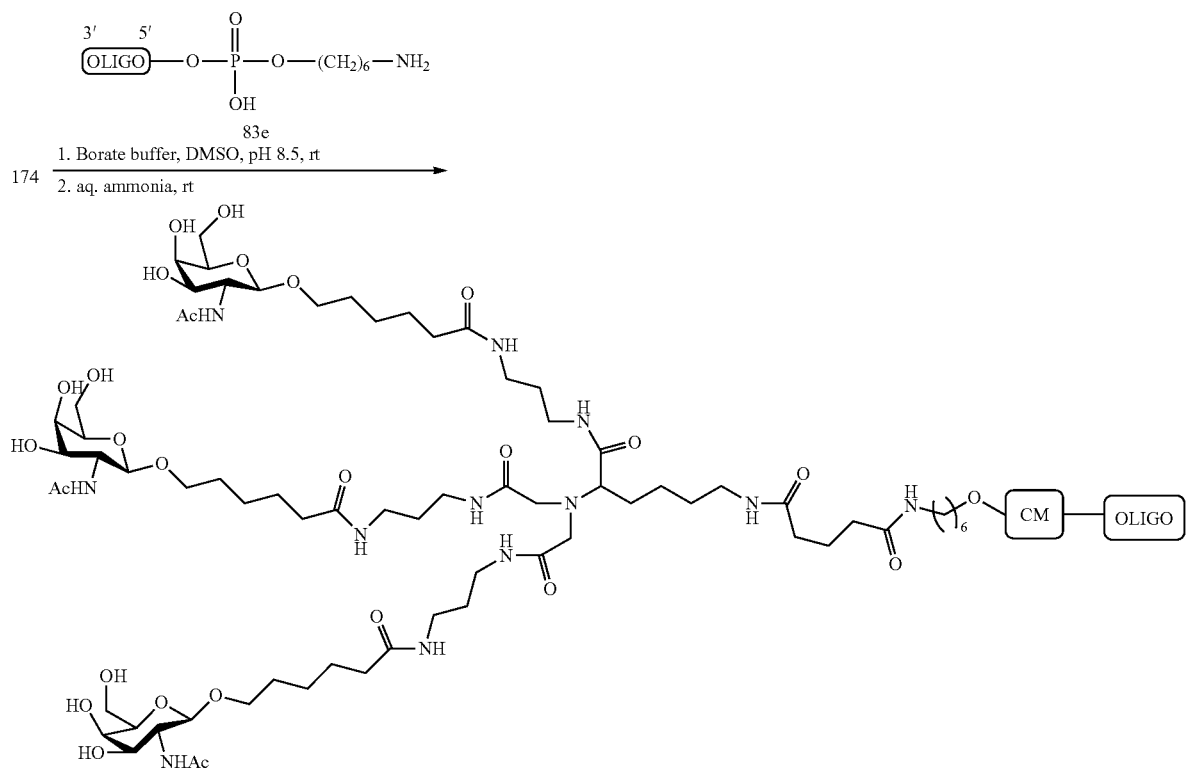

175

Compound 169 is commercially available. Compound 172 was prepared by addition of benzyl (perfluorophenyl) glutarate to compound 171. The benzyl (perfluorophenyl) glutarate was prepared by adding PFP-TFA and DIEA to 5-(benzyloxy)-5-oxopentanoic acid in DMF. Oligomeric compound 175, comprising a GalNAc₃-12 conjugate group, was prepared from compound 174 using the general procedures illustrated in Example 46. The GalNAc₃ cluster portion of the conjugate group GalNAc₃-12 (GalNAc₃-12$_a$) can be combined with any cleavable moiety to provide a variety of conjugate groups. In a certain embodiments, the cleavable moiety is —P(=O)(OH)-A$_d$-P(=O)(OH)—. The structure of GalNAc₃-12 (GalNAc₃-12$_a$-CM-) is shown below:

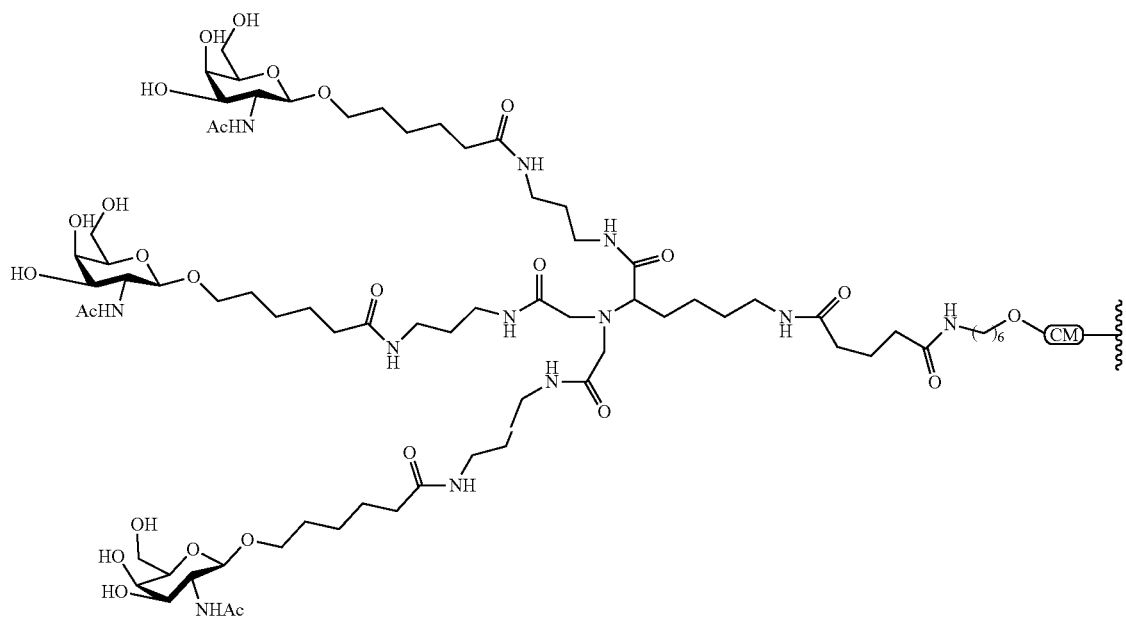
Example 62
Preparation of Oligomeric Compound 180 Comprising GalNAc$_3$-13
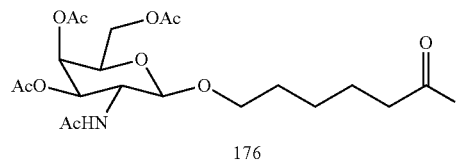
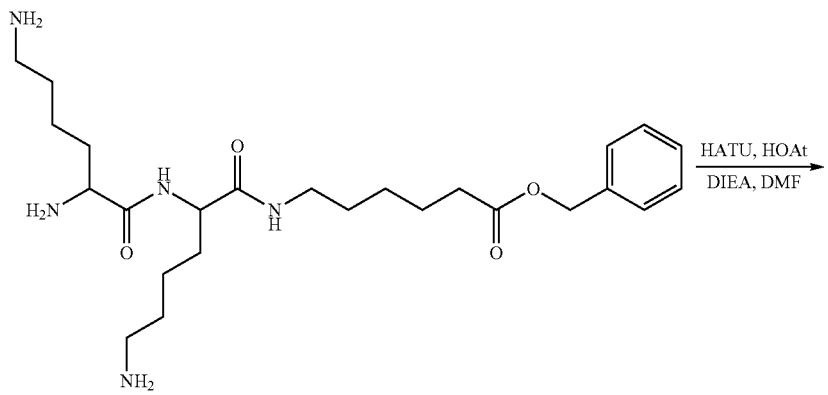

-continued
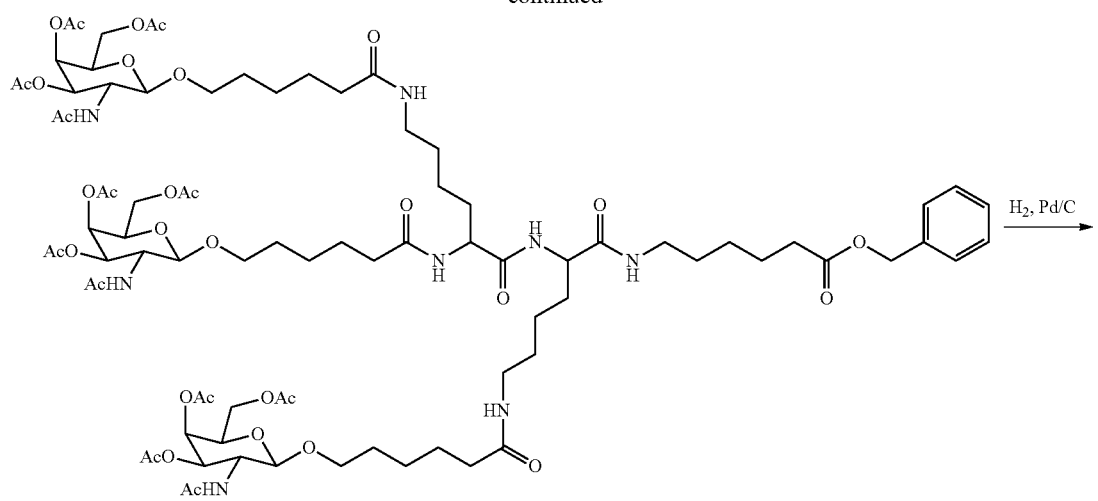
177
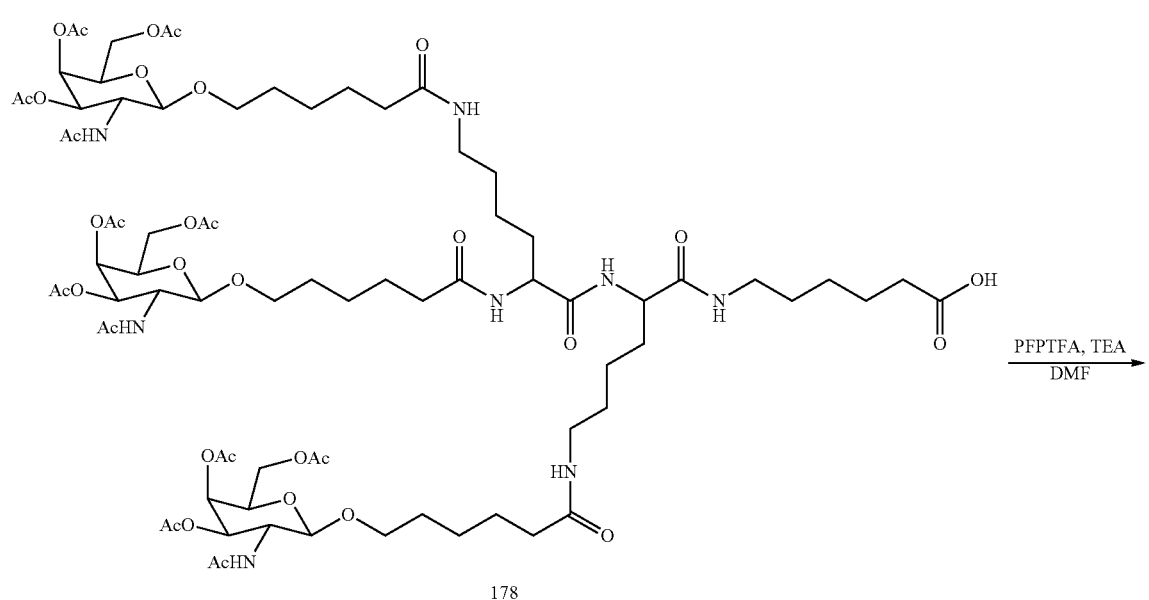
178
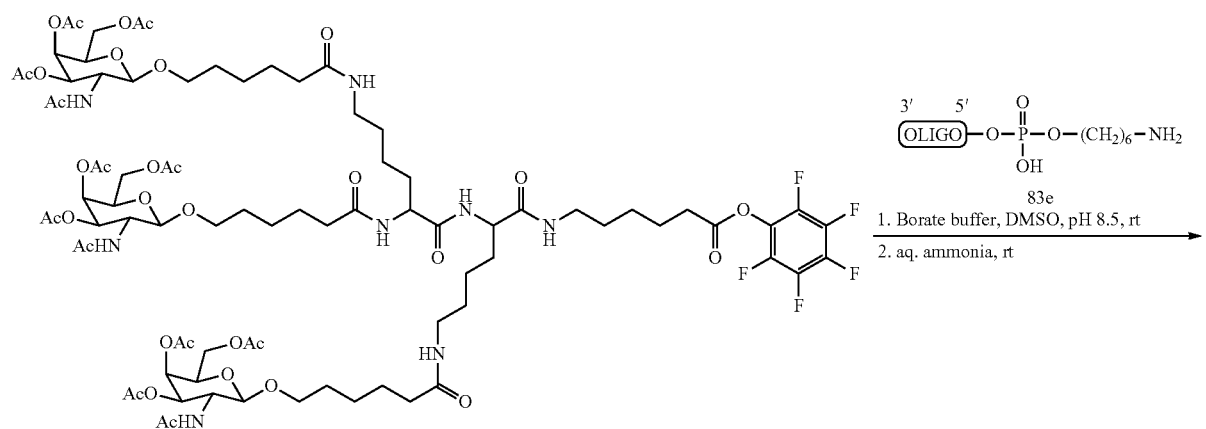
179

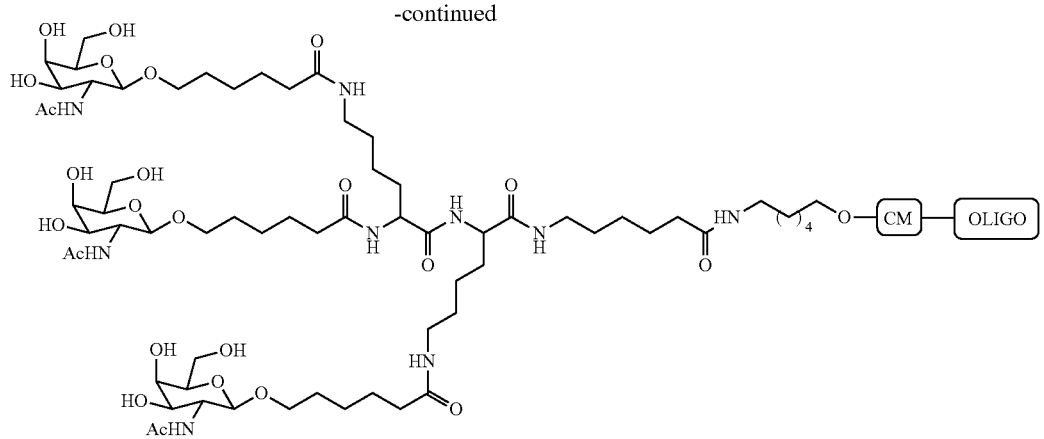

180

Compound 176 was prepared using the general procedure shown in Example 2. Oligomeric compound 180, comprising a GalNAc$_3$-13 conjugate group, was prepared from compound 177 using the general procedures illustrated in Example 49. The GalNAc$_3$ cluster portion of the conjugate group GalNAc$_3$-13 (GalNAc$_3$-13$_a$) can be combined with any cleavable moiety to provide a variety of conjugate groups. In a certain embodiments, the cleavable moiety is —P(=O)(OH)-A$_d$-P(=O)(OH)—. The structure of GalNAc$_3$-13 (GalNAc$_3$-13$_a$-CM-) is shown below:

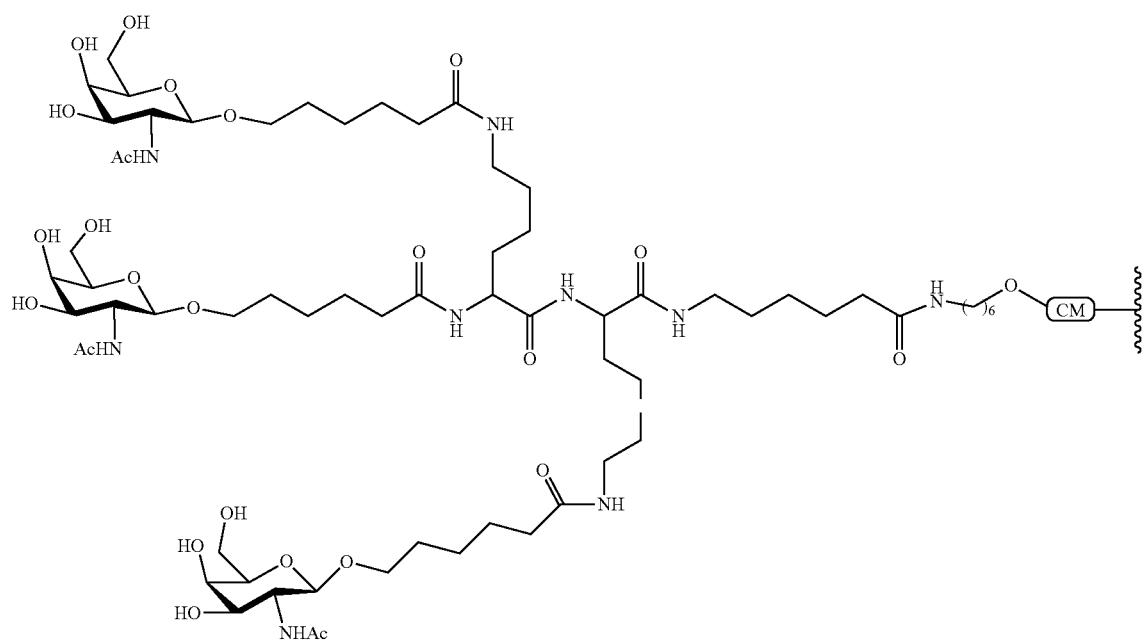

Example 63
Preparation of Oligomeric Compound 188 Comprising GalNAc$_3$-14
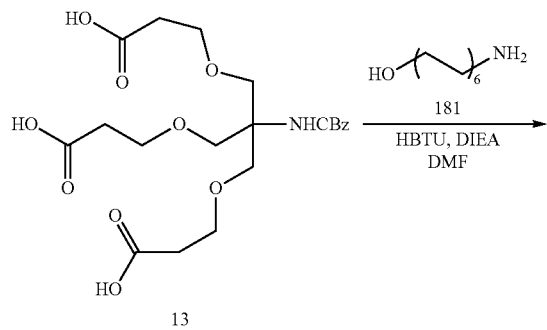
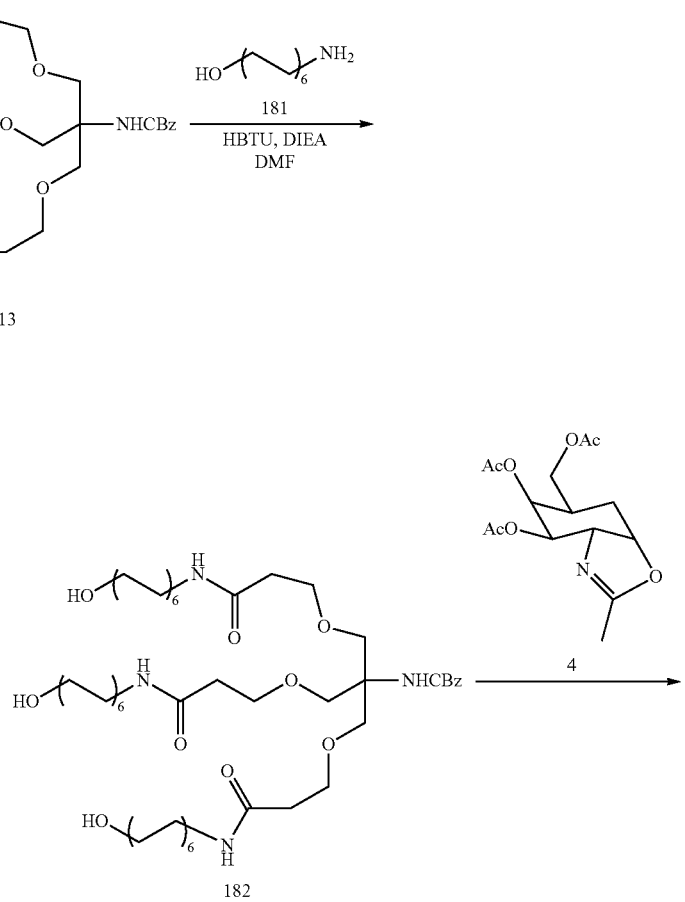
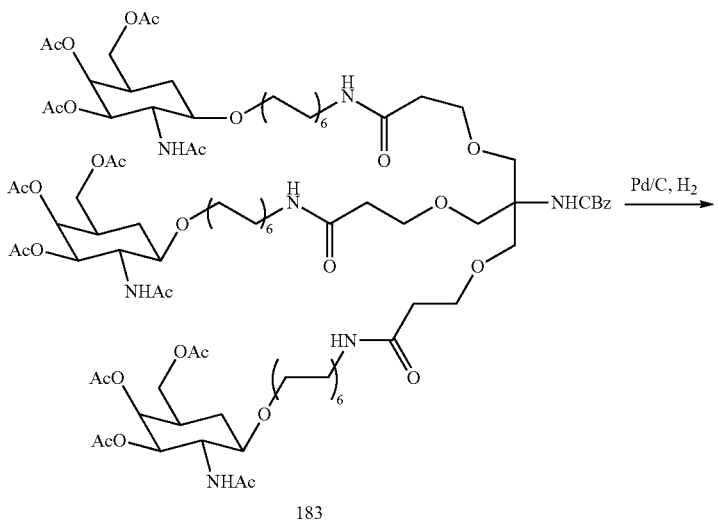

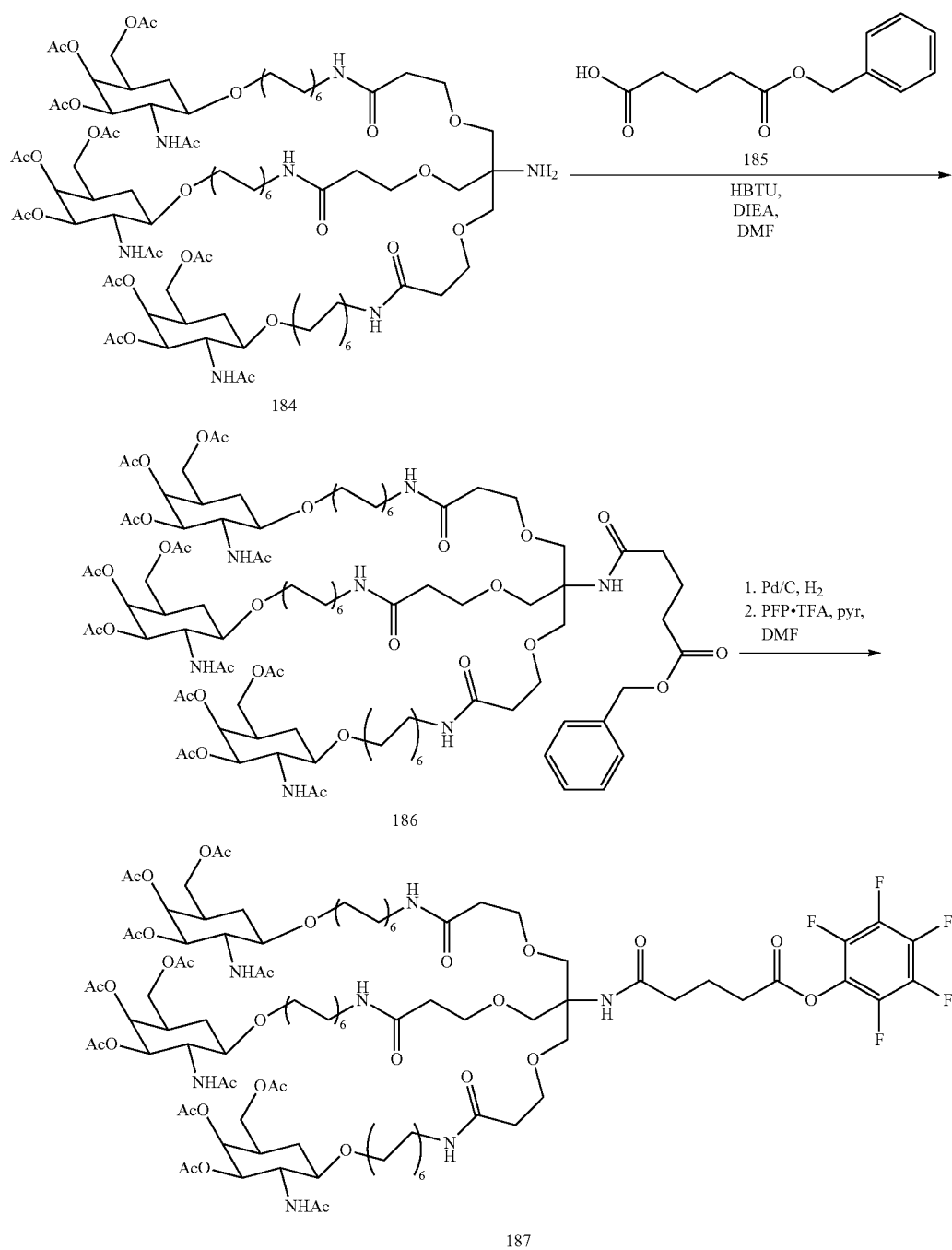
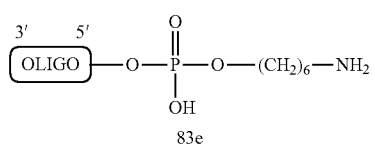
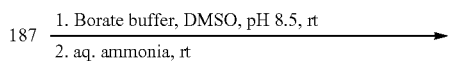

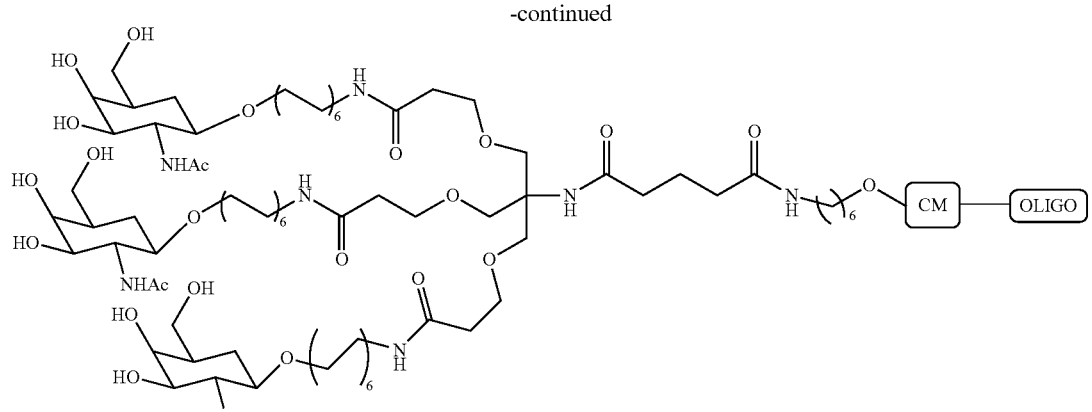

188

Compounds 181 and 185 are commercially available. Oligomeric compound 188, comprising a GalNAc₃-14 conjugate group, was prepared from compound 187 using the general procedures illustrated in Example 46. The GalNAc₃ cluster portion of the conjugate group GalNAc₃-14 (Gal-NAc₃-14$_a$) can be combined with any cleavable moiety to provide a variety of conjugate groups. In certain embodiments, the cleavable moiety is —P(=O)(OH)-A$_d$-P(=O)(OH)—. The structure of GalNAc₃-14 (GalNAc₃-14$_a$-CM-) is shown below:

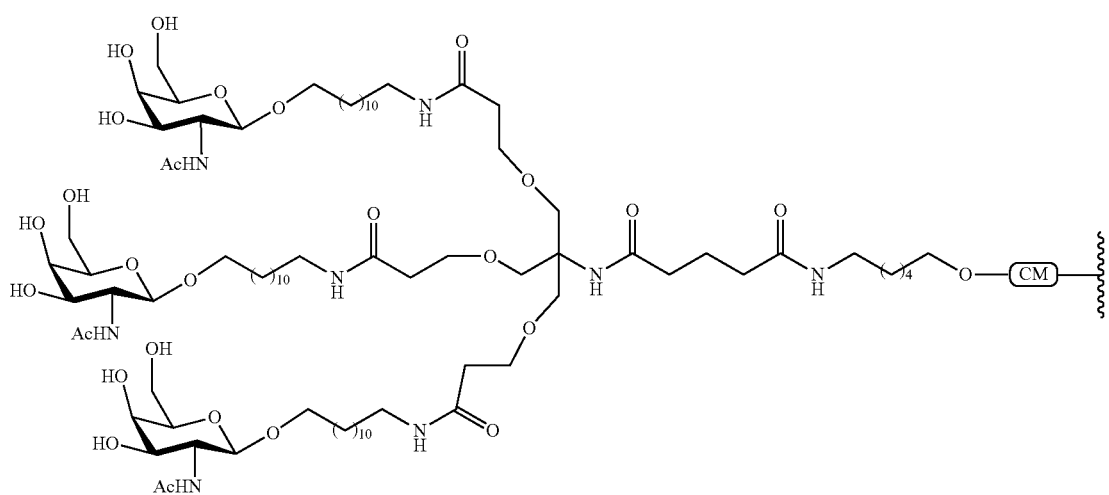

Example 64

Preparation of Oligomeric Compound 197 Comprising GalNAc₃-15

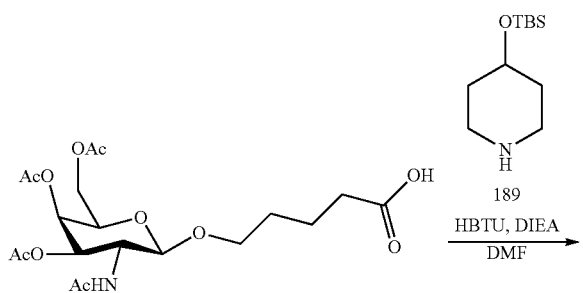

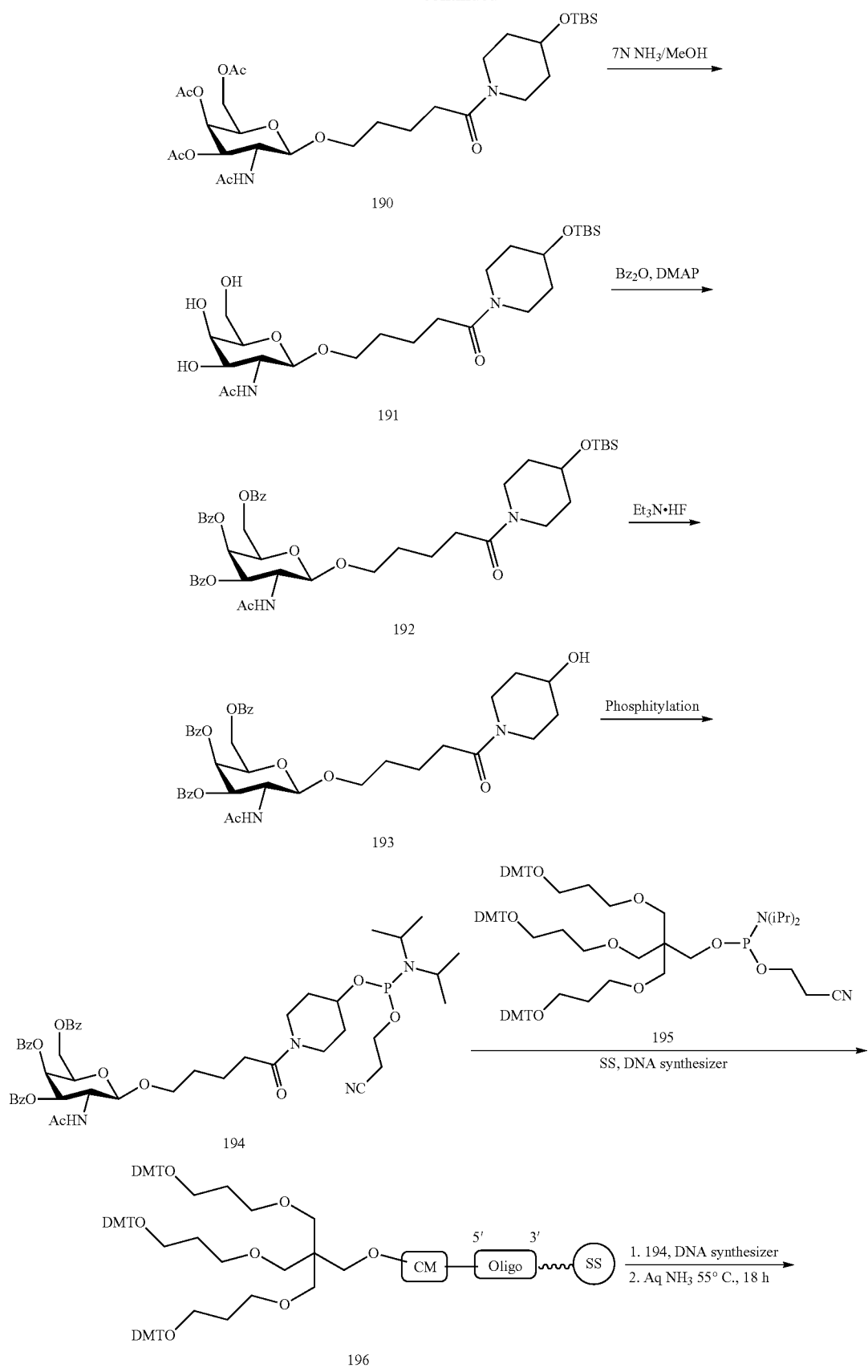

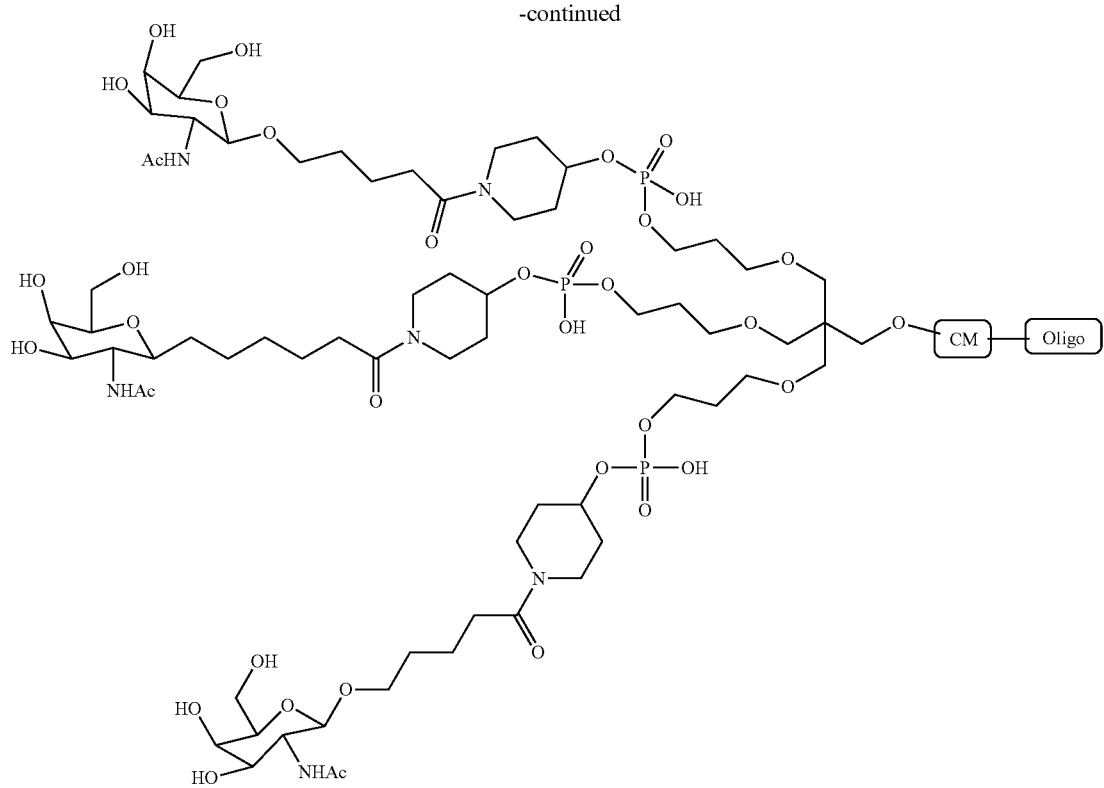

197

Compound 189 is commercially available. Compound 195 was prepared using the general procedure shown in Example 31. Oligomeric compound 197, comprising a GalNAc$_3$-15 conjugate group, was prepared from compounds 194 and 195 using standard oligonucleotide synthesis procedures. The GalNAc$_3$ cluster portion of the conjugate group GalNAc$_3$-15 (GalNAc$_3$-15$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-15 (GalNAc$_3$-15$_a$-CM-) is shown below:

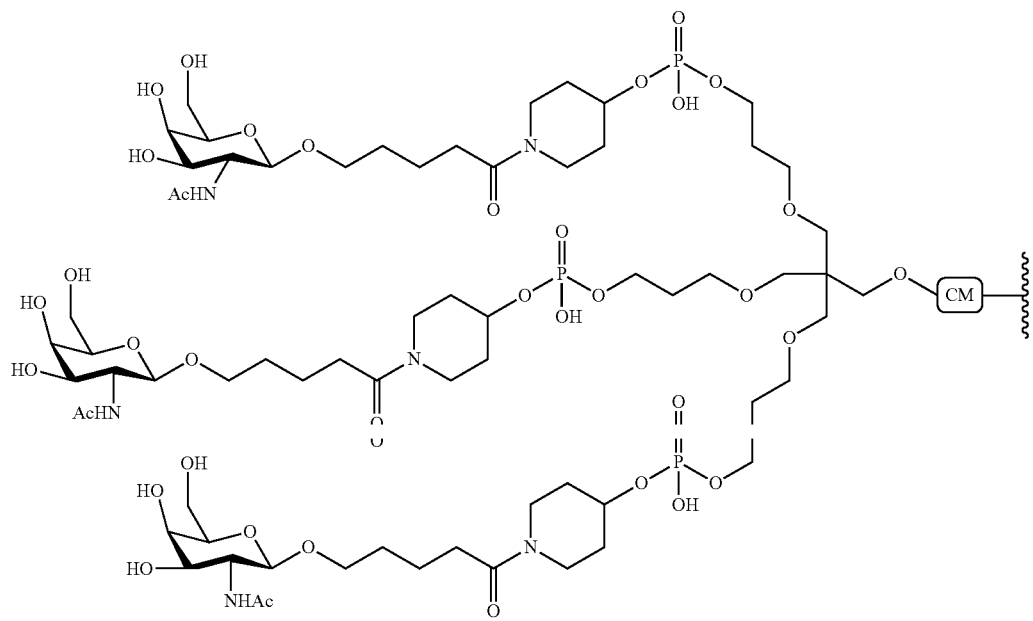

Example 65

Dose-Dependent Study of Oligonucleotides Comprising a 5'-Conjugate Group (Comparison of GalNAc$_3$-3, 12, 13, 14, and 15) Targeting SRB-1 In Vivo The oligonucleotides listed below were tested in a dose-dependent study for antisense inhibition of SRB-1 in mice. Unconjugated ISIS 353382 was included as a standard. Each of the GalNAc$_3$ conjugate groups was attached at the 5' terminus of the respective oligonucleotide by a phosphodiester linked 2'-deoxyadenosine nucleoside (cleavable moiety).

TABLE 54

Modified ASOs targeting SRB-1

| ISIS No. | Sequences (5' to 3') | Conjugate | SEQ ID No. |
|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | none | 2304 |
| 661161 | GalNAc$_3$-3$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3 | 2306 |
| 671144 | GalNAc$_3$-12$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-12 | 2306 |
| 670061 | GalNAc$_3$-13$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-13 | 2306 |
| 671261 | GalNAc$_3$-14$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-14 | 2306 |
| 671262 | GalNAc$_3$-15$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-15 | 2306 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-3$_a$ was shown previously in Example 39. The structure of GalNAc$_3$-12a was shown previously in Example 61. The structure of GalNAc$_3$-13a was shown previously in Example 62. The structure of GalNAc$_3$-14a was shown previously in Example 63. The structure of GalNAc$_3$-15a was shown previously in Example 64.

Treatment

Six to eight week old C57bl6 mice (Jackson Laboratory, Bar Harbor, Me.) were injected subcutaneously once or twice at the dosage shown below with ISIS 353382, 661161, 671144, 670061, 671261, 671262, or with saline. Mice that were dosed twice received the second dose three days after the first dose. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 55, treatment with antisense oligonucleotides lowered SRB-1 mRNA levels in a dose-dependent manner No significant differences in target knockdown were observed between animals that received a single dose and animals that received two doses (see ISIS 353382 dosages 30 and 2×15 mg/kg; and ISIS 661161 dosages 5 and 2×2.5 mg/kg). The antisense oligonucleotides comprising the phosphodiester linked GalNAc$_3$-3, 12, 13, 14, and 15 conjugates showed substantial improvement in potency compared to the unconjugated antisense oligonucleotide (ISIS 335382).

TABLE 55

SRB-1 mRNA (% Saline)

| ISIS No. | Dosage (mg/kg) | SRB-1 mRNA (% Saline) | ED$_{50}$ (mg/kg) | Conjugate |
|---|---|---|---|---|
| Saline | n/a | 100.0 | n/a | n/a |
| 353382 | 3 | 85.0 | 22.4 | none |
|  | 10 | 69.2 |  |  |
|  | 30 | 34.2 |  |  |
|  | 2 × 15 | 36.0 |  |  |
| 661161 | 0.5 | 87.4 | 2.2 | GalNAc$_3$-3 |
|  | 1.5 | 59.0 |  |  |
|  | 5 | 25.6 |  |  |
|  | 2 × 2.5 | 27.5 |  |  |
|  | 15 | 17.4 |  |  |
| 671144 | 0.5 | 101.2 | 3.4 | GalNAc$_3$-12 |
|  | 1.5 | 76.1 |  |  |
|  | 5 | 32.0 |  |  |
|  | 15 | 17.6 |  |  |
| 670061 | 0.5 | 94.8 | 2.1 | GalNAc$_3$-13 |
|  | 1.5 | 57.8 |  |  |
|  | 5 | 20.7 |  |  |
|  | 15 | 13.3 |  |  |
| 671261 | 0.5 | 110.7 | 4.1 | GalNAc$_3$-14 |
|  | 1.5 | 81.9 |  |  |
|  | 5 | 39.8 |  |  |
|  | 15 | 14.1 |  |  |
| 671262 | 0.5 | 109.4 | 9.8 | GalNAc$_3$-15 |
|  | 1.5 | 99.5 |  |  |
|  | 5 | 69.2 |  |  |
|  | 15 | 36.1 |  |  |

Liver transaminase levels, alanine aminotransferase (ALT) and aspartate aminotransferase (AST), in serum were measured relative to saline injected mice using standard protocols. Total bilirubin and BUN were also evaluated. The changes in body weights were evaluated with no significant differences from the saline group (data not shown). ALTs, ASTs, total bilirubin and BUN values are shown in Table 56 below.

TABLE 56

| ISIS No. | Dosage (mg/kg) | ALT (U/L) | AST (U/L) | Total Bilirubin (mg/dL) | BUN (mg/dL) | Conjugate |
|---|---|---|---|---|---|---|
| Saline | n/a | 28 | 60 | 0.1 | 39 | n/a |
| 353382 | 3 | 30 | 77 | 0.2 | 36 | none |
|  | 10 | 25 | 78 | 0.2 | 36 |  |
|  | 30 | 28 | 62 | 0.2 | 35 |  |
|  | 2 × 15 | 22 | 59 | 0.2 | 33 |  |
| 661161 | 0.5 | 39 | 72 | 0.2 | 34 | GalNAc$_3$-3 |
|  | 1.5 | 26 | 50 | 0.2 | 33 |  |
|  | 5 | 41 | 80 | 0.2 | 32 |  |
|  | 2 × 2.5 | 24 | 72 | 0.2 | 28 |  |
|  | 15 | 32 | 69 | 0.2 | 36 |  |
| 671144 | 0.5 | 25 | 39 | 0.2 | 34 | GalNAc$_3$-12 |
|  | 1.5 | 26 | 55 | 0.2 | 28 |  |
|  | 5 | 48 | 82 | 0.2 | 34 |  |
|  | 15 | 23 | 46 | 0.2 | 32 |  |
| 670061 | 0.5 | 27 | 53 | 0.2 | 33 | GalNAc$_3$-13 |
|  | 1.5 | 24 | 45 | 0.2 | 35 |  |
|  | 5 | 23 | 58 | 0.1 | 34 |  |
|  | 15 | 24 | 72 | 0.1 | 31 |  |
| 671261 | 0.5 | 69 | 99 | 0.1 | 33 | GalNAc$_3$-14 |
|  | 1.5 | 34 | 62 | 0.1 | 33 |  |
|  | 5 | 43 | 73 | 0.1 | 32 |  |
|  | 15 | 32 | 53 | 0.2 | 30 |  |
| 671262 | 0.5 | 24 | 51 | 0.2 | 29 | GalNAc$_3$-15 |
|  | 1.5 | 32 | 62 | 0.1 | 31 |  |
|  | 5 | 30 | 76 | 0.2 | 32 |  |
|  | 15 | 31 | 64 | 0.1 | 32 |  |

Example 66

Effect of Various Cleavable Moieties on Antisense Inhibition In Vivo by Oligonucleotides Targeting SRB-1 Comprising a 5'-GalNAc$_3$ Cluster The oligonucleotides listed below were tested in a dose-dependent study for antisense inhibition of SRB-1 in mice. Each of the GalNAc$_3$ conjugate groups was attached at the 5' terminus of the respective oligonucleotide by a phosphodiester linked nucleoside (cleavable moiety (CM)).

TABLE 57

Modified ASOs targeting SRB-1

| ISIS No. | Sequences (5' to 3') | GalNAc$_3$ Cluster | CM | SEQ ID No. |
|---|---|---|---|---|
| 661161 | GalNAc$_3$-3$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3a | A$_d$ | 2306 |
| 670690 | GalNAc$_3$-3$_{a-o'}$T$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{eo}$$^m$C$_{eo}$$^m$C$_{es}$T$_{es}$T$_e$ | GalNAc$_3$-3a | T$_d$ | 2309 |
| 670700 | GalNAc$_3$-3$_{a-o'}$A$_{eo}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{eo}$$^m$C$_{eo}$$^m$C$_{es}$T$_{es}$T$_e$ | GalNAc$_3$-3a | A$_e$ | 2306 |
| 670701 | GalNAc$_3$-3$_{a-o'}$T$_{eo}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{eo}$$^m$C$_{eo}$$^m$C$_{es}$T$_{es}$T$_e$ | GalNAc$_3$-3a | T$_e$ | 2309 |
| 671165 | GalNAc$_3$-13$_{a-o'}$A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{eo}$$^m$C$_{eo}$$^m$C$_{es}$T$_{es}$T$_e$ | GalNAc$_3$-13a | A$_d$ | 2306 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P (=O)(OH)—. Conjugate groups are in bold.

The structure of GalNAc$_3$-3$_a$ was shown previously in Example 39. The structure of GalNAc$_3$-13a was shown previously in Example 62.

Treatment

Six to eight week old C57BL/6 mice (Jackson Laboratory, Bar Harbor, Me.) were injected subcutaneously once at the dosage shown below with ISIS 661161, 670699, 670700, 670701, 671165, or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 58, treatment with antisense oligonucleotides lowered SRB-1 mRNA levels in a dose-dependent manner. The antisense oligonucleotides comprising various cleavable moieties all demonstrated similar potencies.

TABLE 58

| ISIS No. | Dosage (mg/kg) | SRB-1 mRNA (% Saline) | GalNAc$_3$ Cluster | CM |
|---|---|---|---|---|
| Saline | n/a | 100.0 | n/a | n/a |
| 661161 | 0.5 | 87.8 | GalNAc$_3$-3a | A$_d$ |
|  | 1.5 | 61.3 |  |  |
|  | 5 | 33.8 |  |  |
|  | 15 | 14.0 |  |  |
| 670699 | 0.5 | 89.4 | GalNAc$_3$-3a | T$_d$ |
|  | 1.5 | 59.4 |  |  |
|  | 5 | 31.3 |  |  |
|  | 15 | 17.1 |  |  |
| 670700 | 0.5 | 79.0 | GalNAc$_3$-3a | A$_e$ |
|  | 1.5 | 63.3 |  |  |
|  | 5 | 32.8 |  |  |
|  | 15 | 17.9 |  |  |

TABLE 58-continued

SRB-1 mRNA (% Saline)

| ISIS No. | Dosage (mg/kg) | SRB-1 mRNA (% Saline) | GalNAc₃ Cluster | CM |
|---|---|---|---|---|
| 670701 | 0.5 | 79.1 | GalNAc₃-3a | $T_e$ |
| | 1.5 | 59.2 | | |
| | 5 | 35.8 | | |
| | 15 | 17.7 | | |
| 671165 | 0.5 | 76.4 | GalNAc₃-13a | $A_d$ |
| | 1.5 | 43.2 | | |
| | 5 | 22.6 | | |
| | 15 | 10.0 | | |

Liver transaminase levels, alanine aminotransferase (ALT) and aspartate aminotransferase (AST), in serum were measured relative to saline injected mice using standard protocols. Total bilirubin and BUN were also evaluated. The changes in body weights were evaluated with no significant differences from the saline group (data not shown). ALTs, ASTs, total bilirubin and BUN values are shown in Table 59 below.

TABLE 59

| ISIS No. | Dosage (mg/kg) | ALT (U/L) | AST (U/L) | Total Bilirubin (mg/dL) | BUN (mg/dL) | GalNAc₃ Cluster | CM |
|---|---|---|---|---|---|---|---|
| Saline | n/a | 24 | 64 | 0.2 | 31 | n/a | n/a |
| 661161 | 0.5 | 25 | 64 | 0.2 | 31 | GalNAc₃-3a | $A_d$ |
| | 1.5 | 24 | 50 | 0.2 | 32 | | |
| | 5 | 26 | 55 | 0.2 | 28 | | |
| | 15 | 27 | 52 | 0.2 | 31 | | |
| 670699 | 0.5 | 42 | 83 | 0.2 | 31 | GalNAc₃-3a | $T_d$ |
| | 1.5 | 33 | 58 | 0.2 | 32 | | |
| | 5 | 26 | 70 | 0.2 | 29 | | |
| | 15 | 25 | 67 | 0.2 | 29 | | |
| 670700 | 0.5 | 40 | 74 | 0.2 | 27 | GalNAc₃-3a | $A_e$ |
| | 1.5 | 23 | 62 | 0.2 | 27 | | |
| | 5 | 24 | 49 | 0.2 | 29 | | |
| | 15 | 25 | 87 | 0.1 | 25 | | |
| 670701 | 0.5 | 30 | 77 | 0.2 | 27 | GalNAc₃-3a | $T_e$ |
| | 1.5 | 25 | 55 | 0.2 | 30 | | |
| | 5 | 81 | 101 | 0.2 | 25 | | |
| | 15 | 31 | 82 | 0.2 | 24 | | |
| 671165 | 0.5 | 44 | 84 | 0.2 | 26 | GalNAc₃-13a | $A_d$ |
| | 1.5 | 47 | 71 | 0.1 | 24 | | |
| | 5 | 33 | 91 | 0.2 | 26 | | |
| | 15 | 33 | 56 | 0.2 | 29 | | |

Example 67

Preparation of Oligomeric Compound 199 Comprising GalNAc₃-16

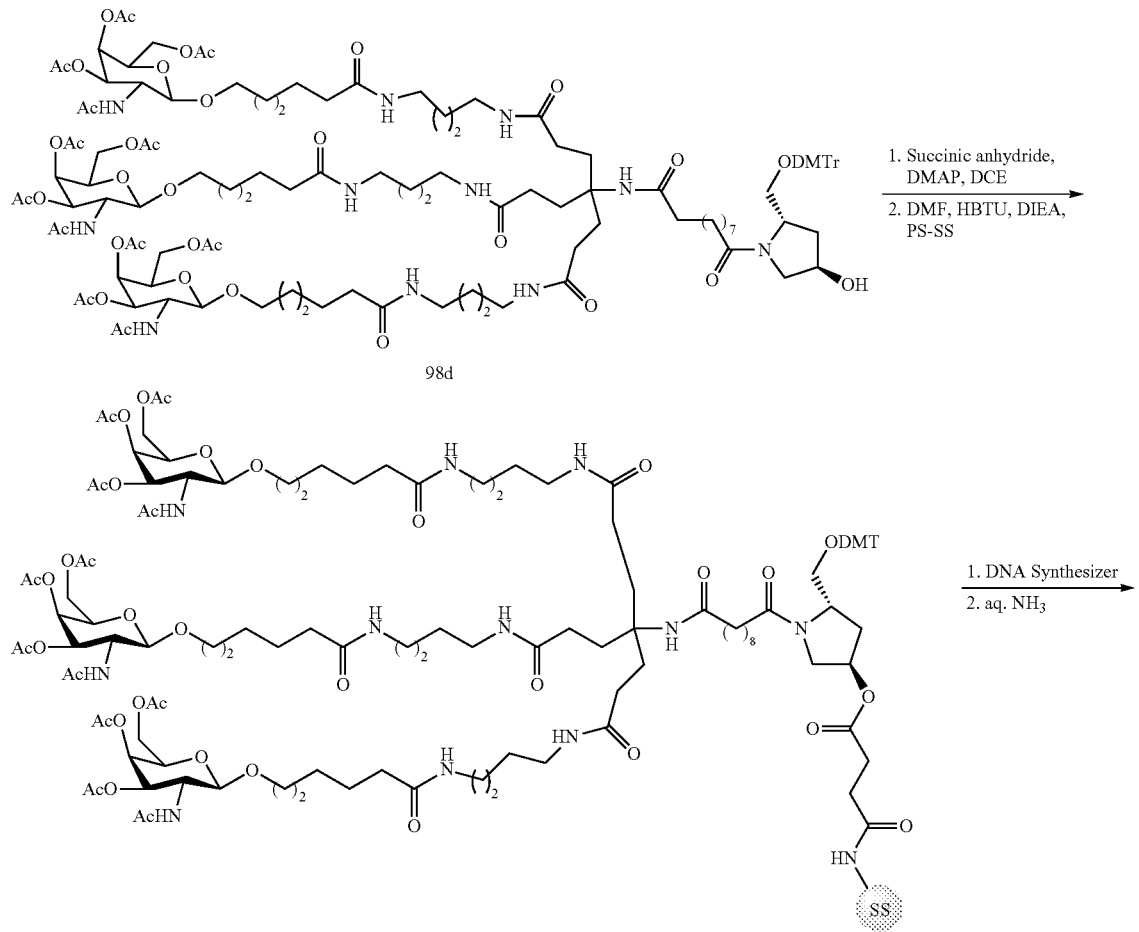

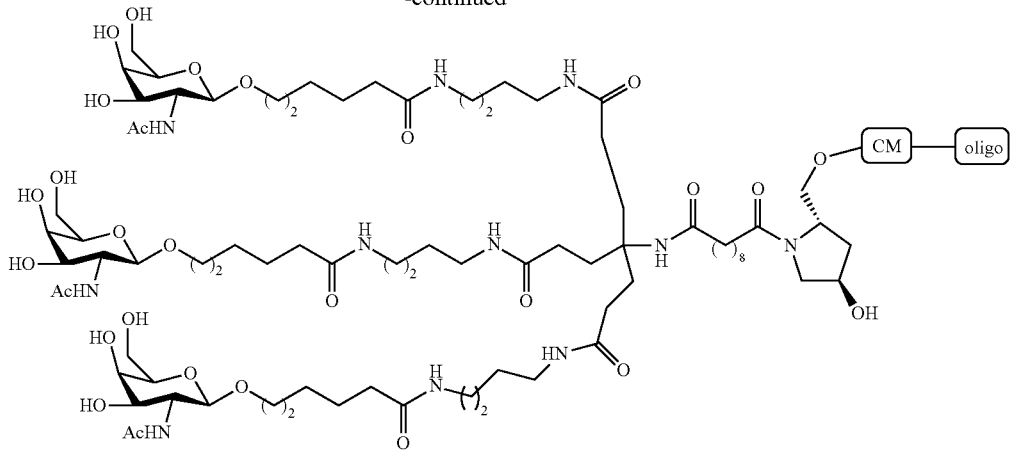

199

Oligomeric compound 199, comprising a GalNAc₃-16 conjugate group, is prepared using the general procedures illustrated in Examples 7 and 9. The GalNAc₃ cluster portion of the conjugate group GalNAc₃-16 (GalNAc₃-16$_a$) can be combined with any cleavable moiety to provide a variety of conjugate groups. In certain embodiments, the cleavable moiety is —P(=O)(OH)-A$_d$-P(=O)(OH)—. The structure of GalNAc₃-16 (GalNAc₃-16$_a$-CM-) is shown below:

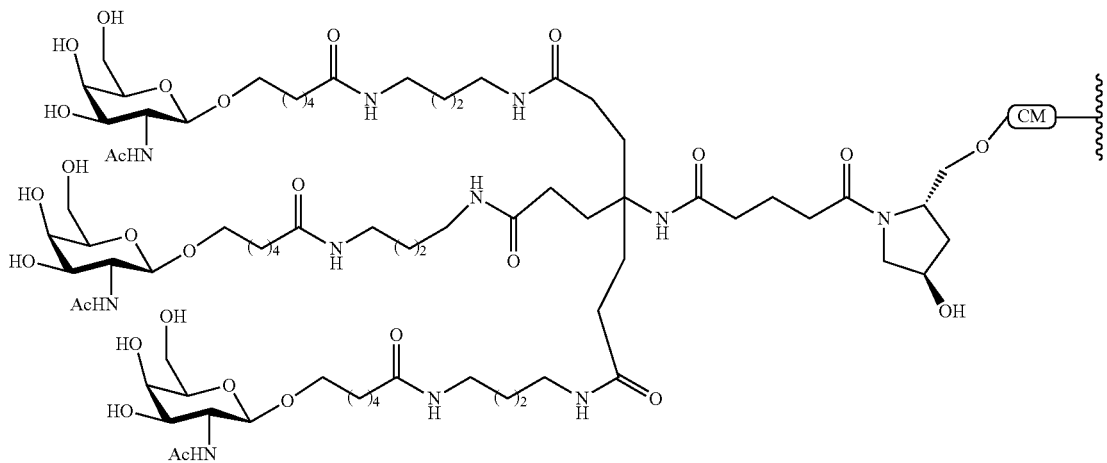

Example 68

Preparation of Oligomeric Compound 200 Comprising GalNAc₃-17

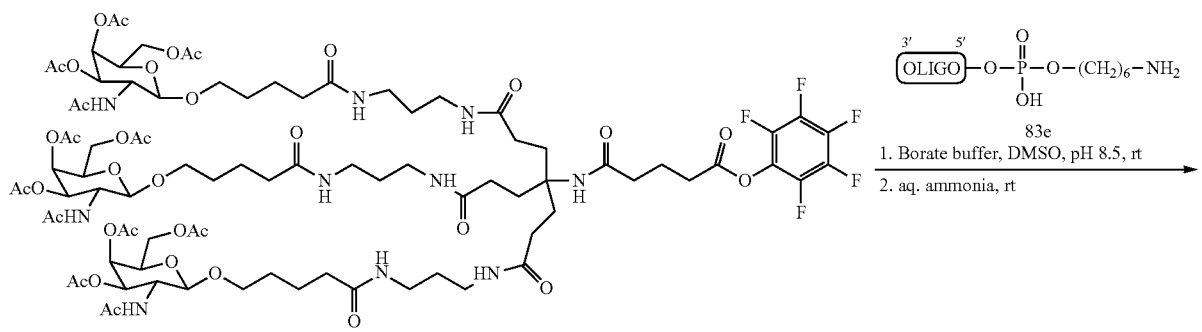

102a

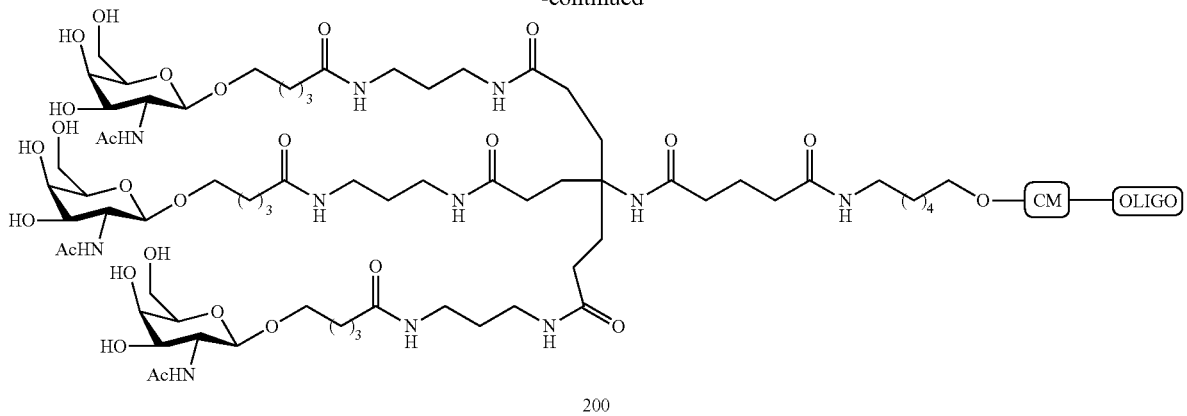

200

Oligomeric compound 200, comprising a GalNAc$_3$-17 conjugate group, was prepared using the general procedures illustrated in Example 46. The GalNAc$_3$ cluster portion of the conjugate group GalNAc$_3$-17 (GalNAc$_3$-17$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-17 (GalNAc$_3$-17$_a$-CM-) is shown below:

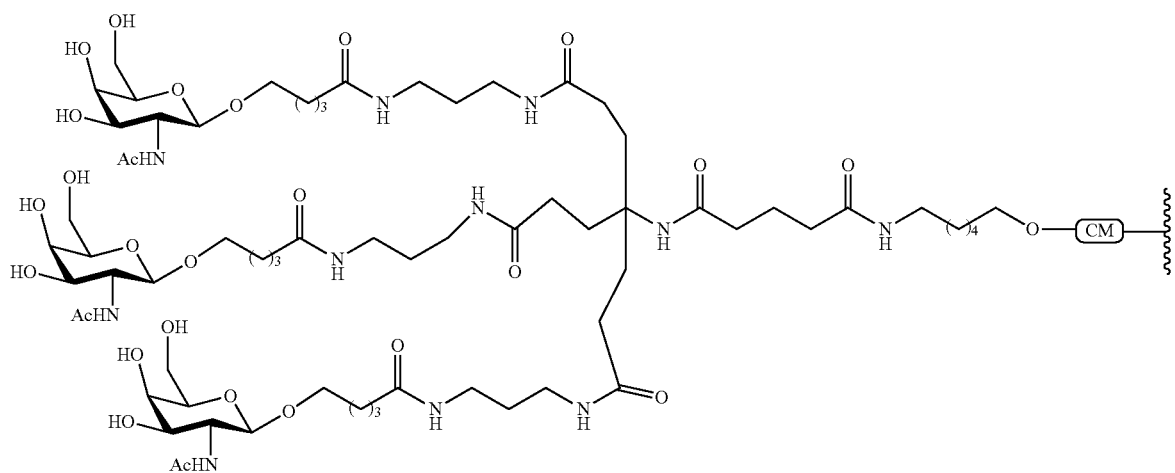

Example 69

Preparation of Oligomeric Compound 201 Comprising GalNAc$_3$-18

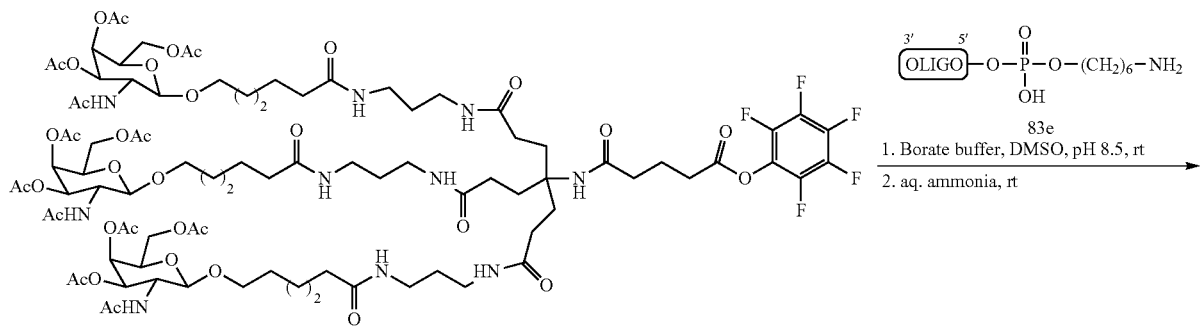

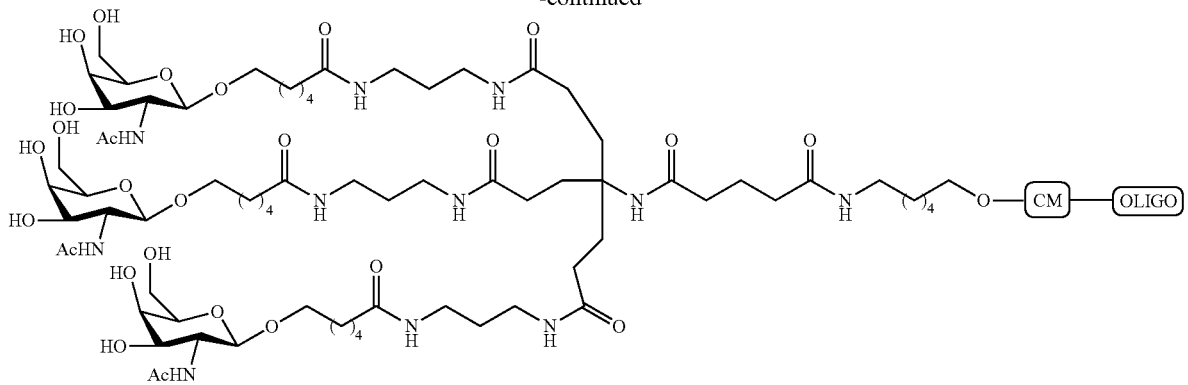

201

Oligomeric compound 201, comprising a GalNAc$_3$-18 conjugate group, was prepared using the general procedures illustrated in Example 46. The GalNAc$_3$ cluster portion of the conjugate group GalNAc$_3$-18 (GalNAc$_3$-18$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-18 (GalNAc$_3$-18$_a$-CM-) is shown below:

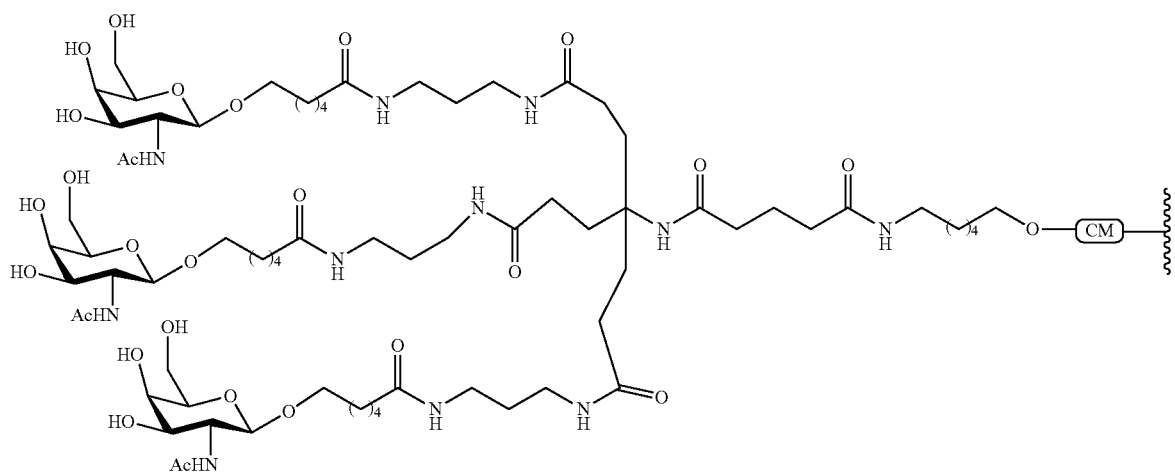

Example 70

Preparation of Oligomeric Compound 204 Comprising GalNAc$_3$-19

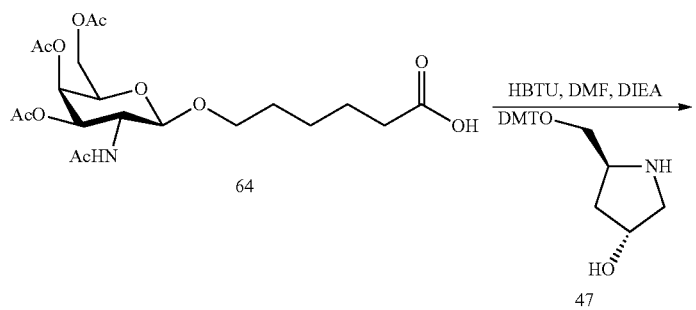

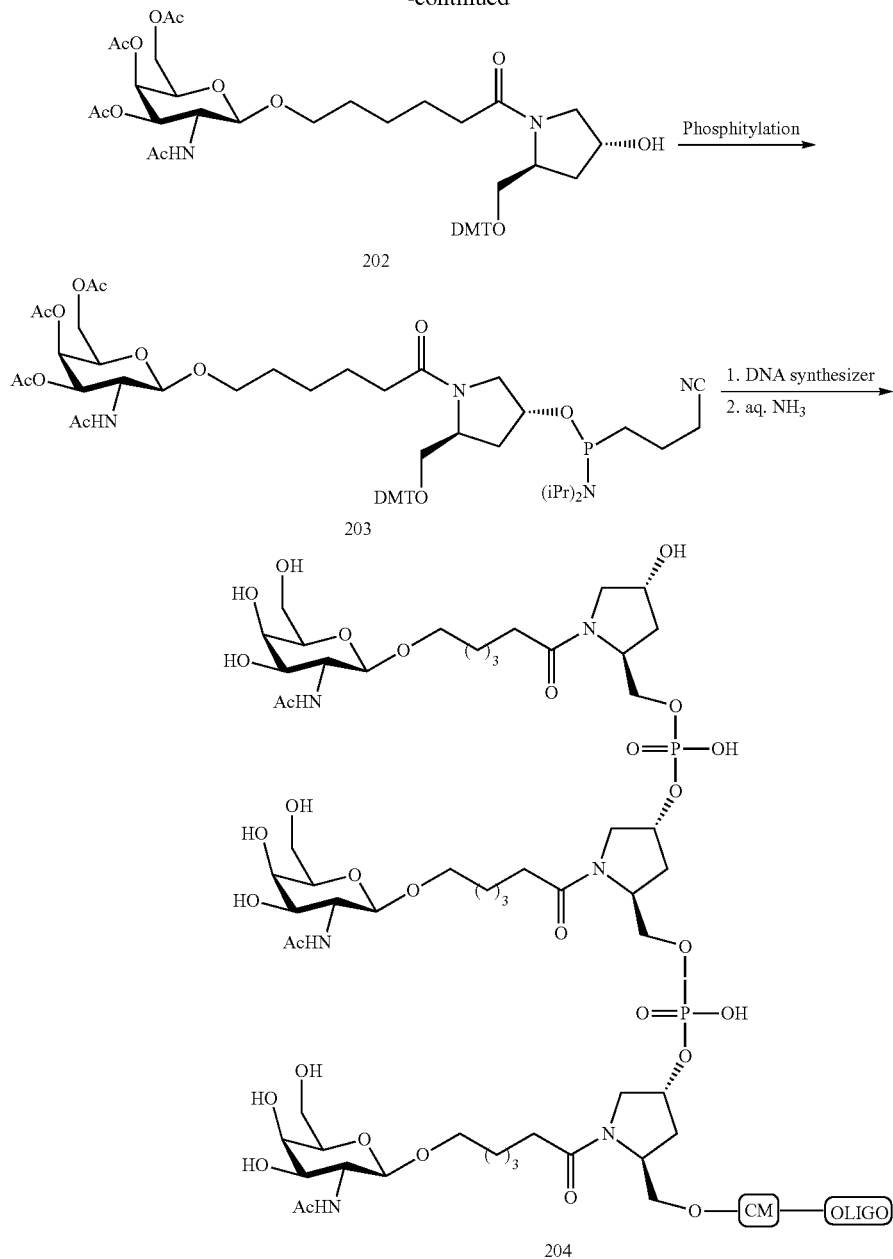

Oligomeric compound 204, comprising a GalNAc$_3$-19 conjugate group, was prepared from compound 64 using the general procedures illustrated in Example 52. The GalNAc$_3$ cluster portion of the conjugate group GalNAc$_3$-19 (GalNAc$_3$-19$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-19 (GalNAc$_3$-19$_a$-CM-) is shown below:

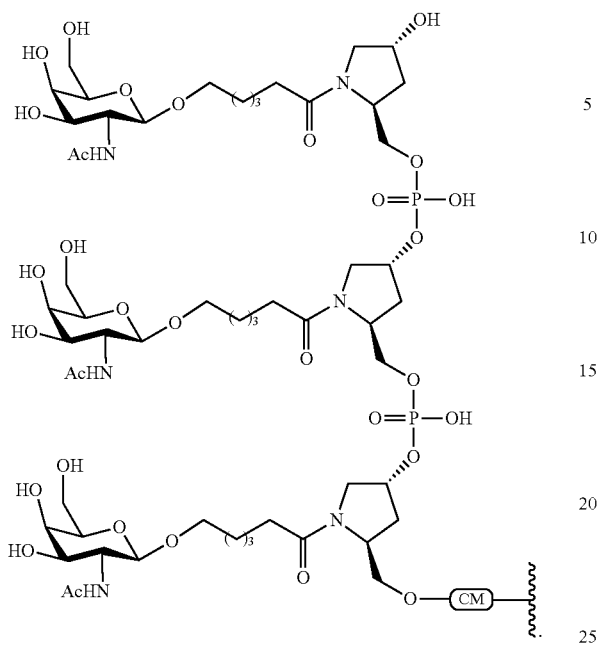
Example 71
Preparation of Oligomeric Compound 210 Comprising GalNAc$_3$-20
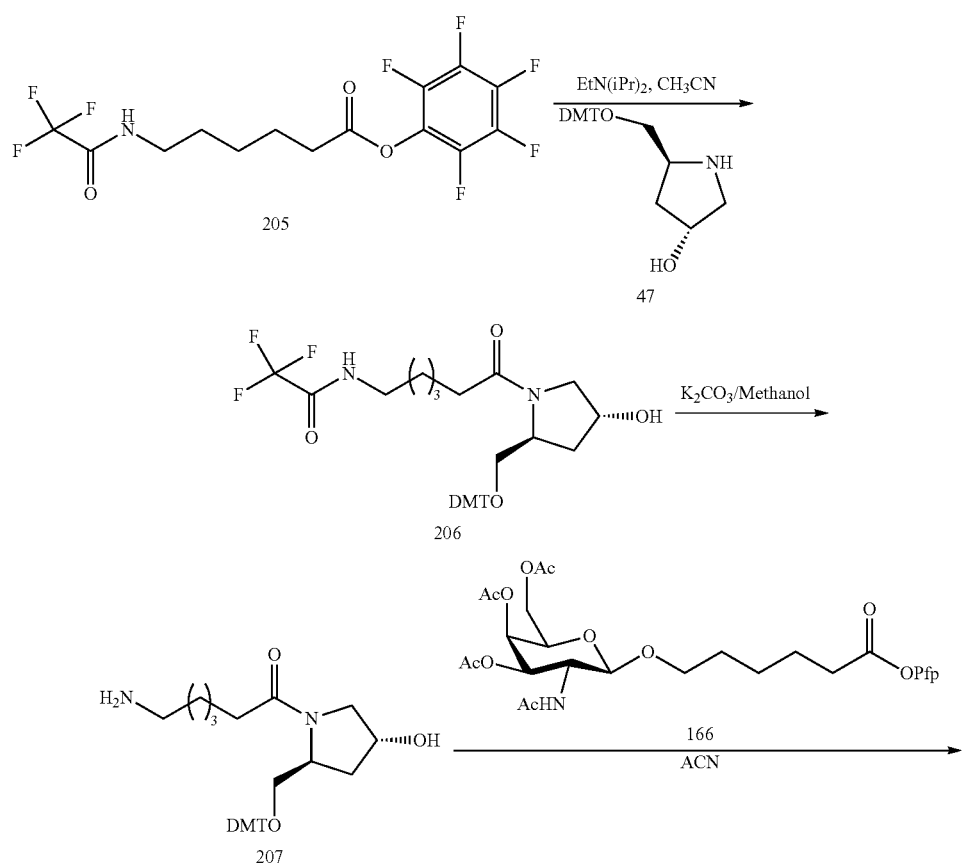

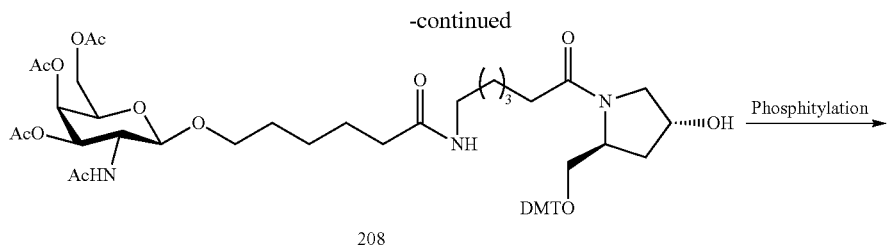

208

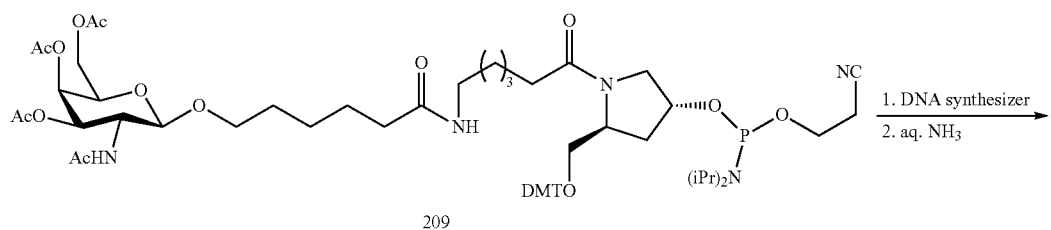

209

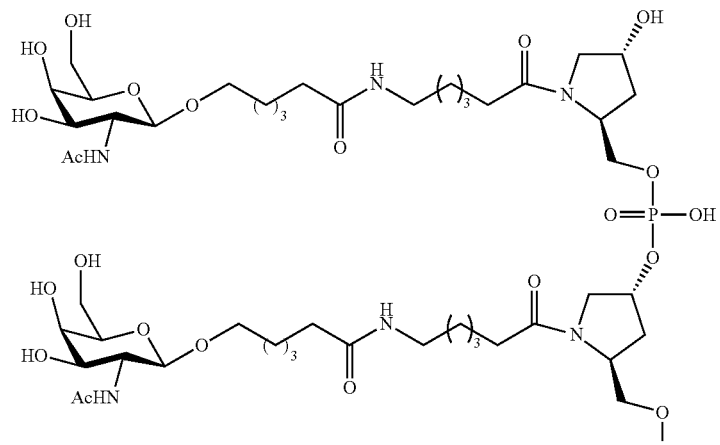

210

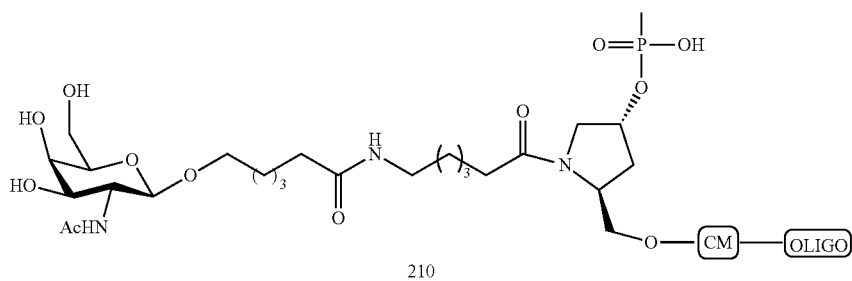

Compound 205 was prepared by adding PFP-TFA and DIEA to 6-(2,2,2-trifluoroacetamido)hexanoic acid in acetonitrile, which was prepared by adding triflic anhydride to 6-aminohexanoic acid. The reaction mixture was heated to 80° C., then lowered to rt. Oligomeric compound 210, comprising a GalNAc$_3$-20 conjugate group, was prepared from compound 208 using the general procedures illustrated in Example 52. The GalNAc$_3$ cluster portion of the conjugate group GalNAc$_3$-20 (GalNAc$_3$-20$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-20 (GalNAc$_3$-20$_a$-CM-) is shown below:

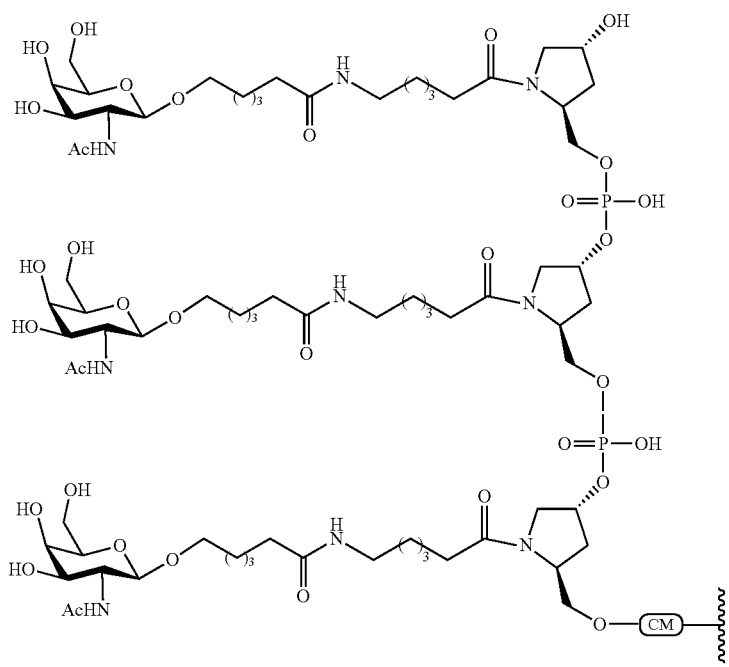
Example 72
Preparation of Oligomeric Compound 215 Comprising GalNAc$_3$-21
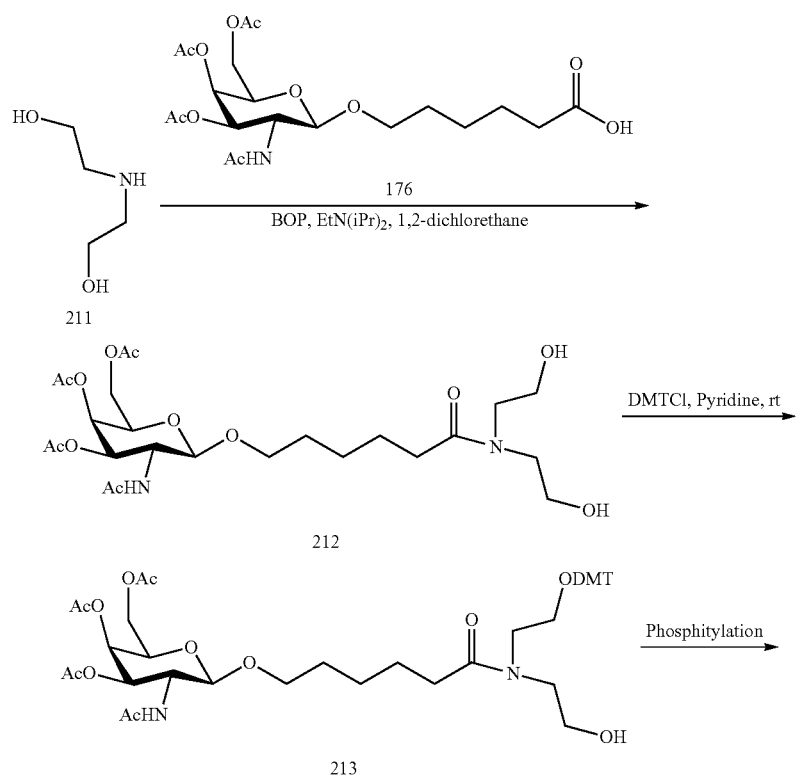

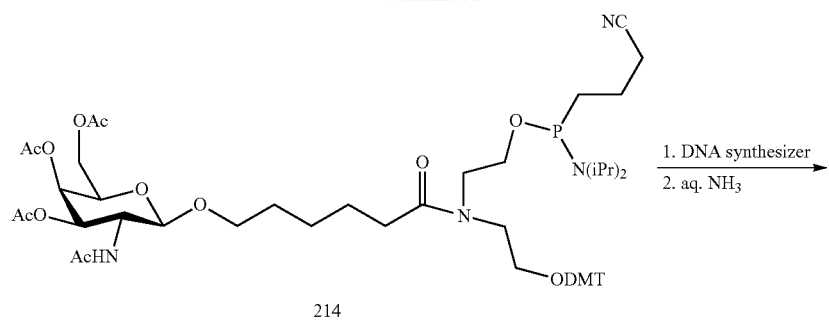
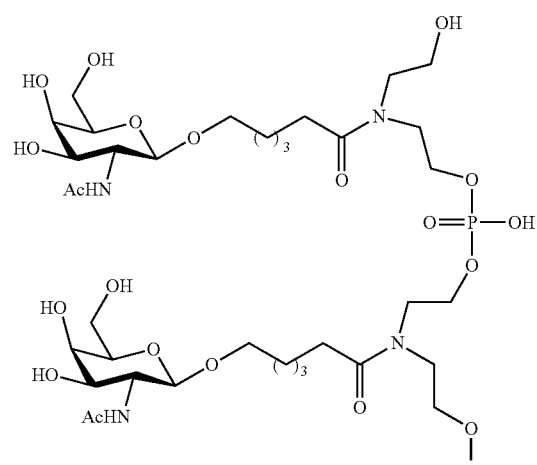
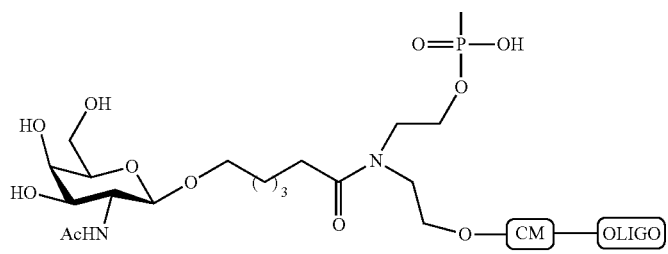

Compound 211 is commercially available. Oligomeric compound 215, comprising a GalNAc$_3$-21 conjugate group, was prepared from compound 213 using the general procedures illustrated in Example 52. The GalNAc$_3$ cluster portion of the conjugate group GalNAc$_3$-21 (GalNAc$_3$-21$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-21 (GalNAc$_3$-21$_a$-CM-) is shown below:

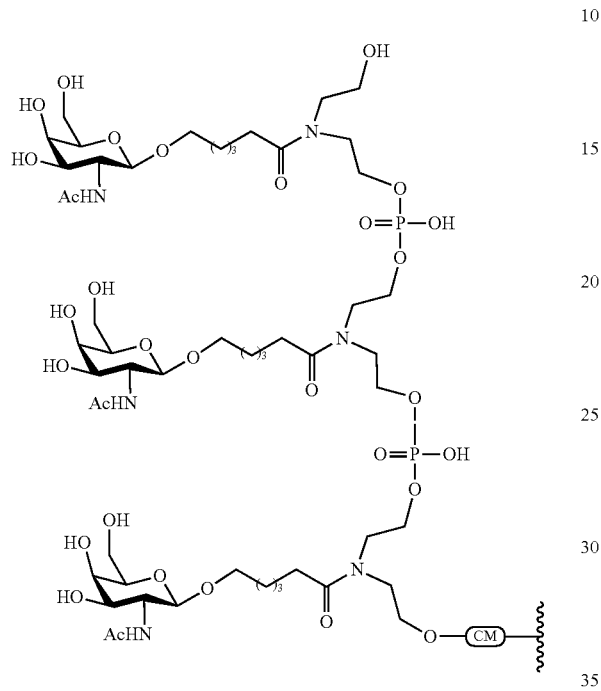

Example 73

Preparation of Oligomeric Compound 221 Comprising GalNAc$_3$-22

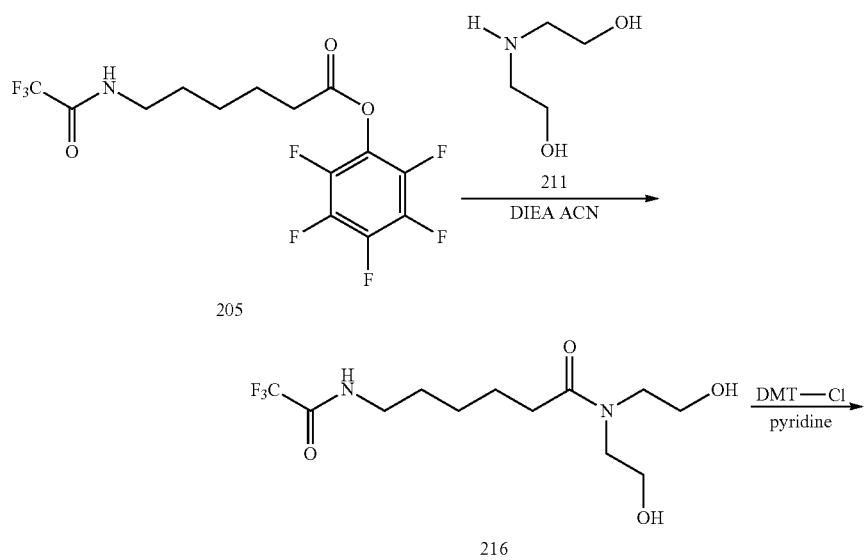

-continued
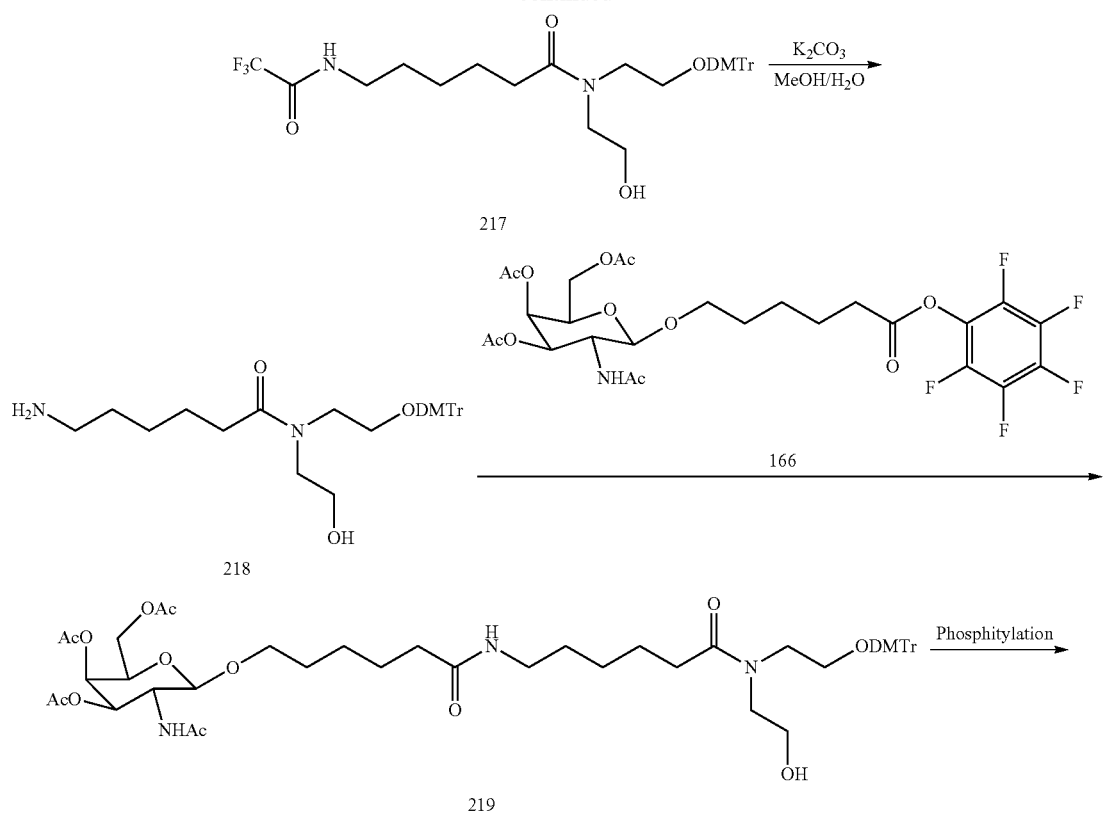
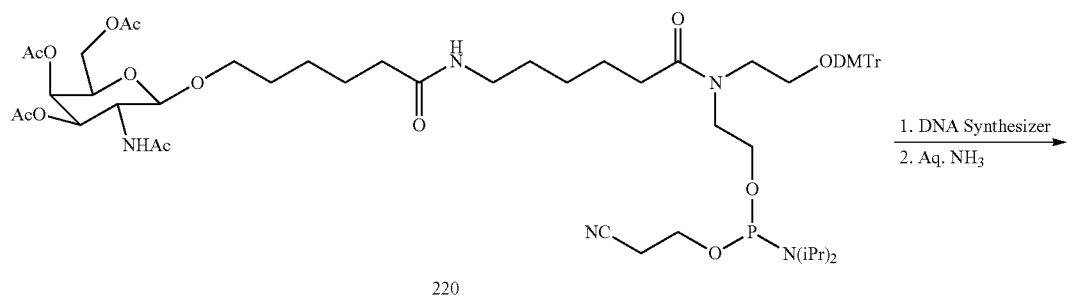
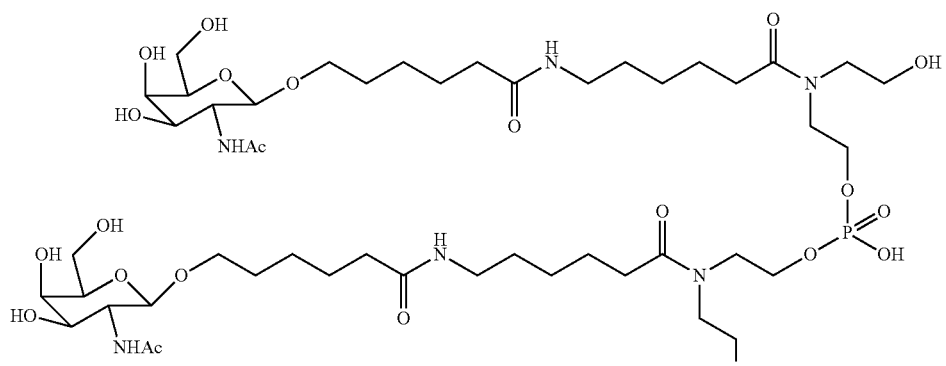

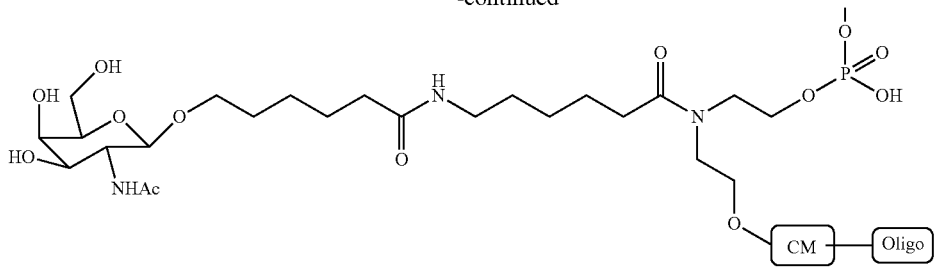

221

Compound 220 was prepared from compound 219 using diisopropylammonium tetrazolide. Oligomeric compound 221, comprising a GalNAc$_3$-21 conjugate group, is prepared from compound 220 using the general procedure illustrated in Example 52. The GalNAc$_3$ cluster portion of the conjugate group GalNAc$_3$-22 (GalNAc$_3$-22$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-22 (GalNAc$_3$-22$_a$-CM-) is shown below:

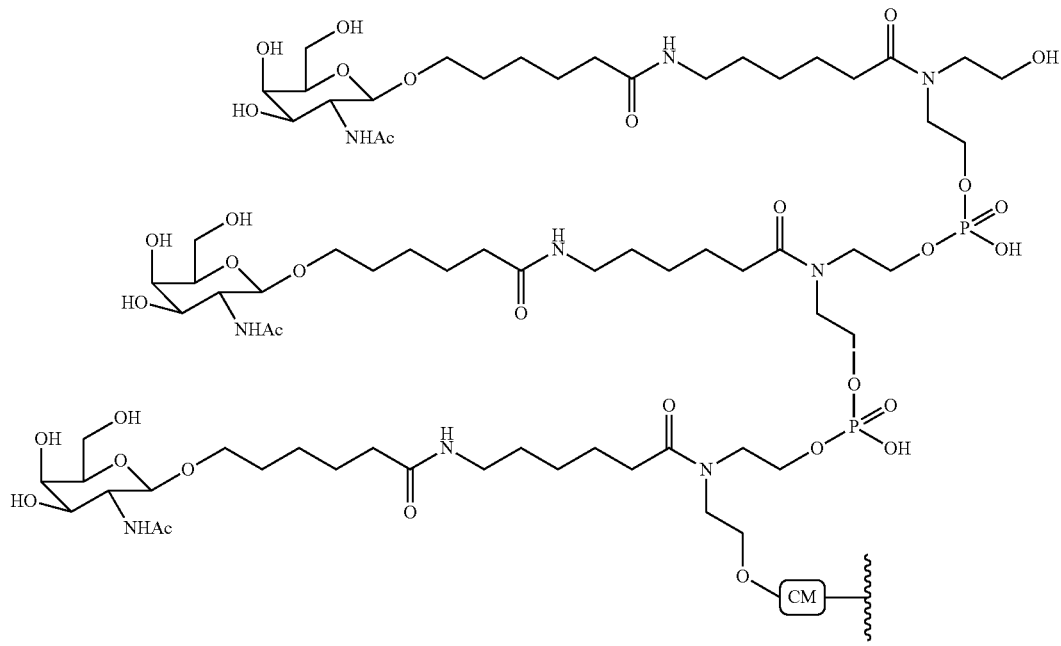

Example 74

Effect of Various Cleavable Moieties on Antisense Inhibition In Vivo by Oligonucleotides Targeting SRB-1 Comprising a 5'-GalNAc$_3$ Conjugate The oligonucleotides listed below were tested in a dose-dependent study for antisense inhibition of SRB-1 in mice. Each of the GalNAc$_3$ conjugate groups was attached at the 5' terminus of the respective oligonucleotide.

TABLE 60

Modified ASOs targeting SRB-1

| ISIS No. | Sequences (5' to 3') | GalNAc₃ Cluster | CM | SEQ ID No. |
|---|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | n/a | n/a | 2304 |
| 661161 | GalNAc₃-3$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | GalNAc₃-3a | A$_d$ | 2306 |
| 666904 | GalNAc₃-3$_a$-$_o$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | GalNAc₃-3a | PO | 2304 |
| 675441 | GalNAc₃-17$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | GalNAc₃-17a | A$_d$ | 2306 |
| 675442 | GalNAc₃-18$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | GalNAc₃-18a | A$_d$ | 2306 |

In all tables, capital letters indicate the nucleobase for each nucleoside and $^m$C indicates a 5-methyl cytosine. Subscripts: "e" indicates a 2'-MOE modified nucleoside; "d" indicates β-D-2'-deoxyribonucleoside; "s" indicates a phosphorothioate internucleoside linkage (PS); "o" indicates a phosphodiester internucleoside linkage (PO); and "o'" indicates —O—P(═O)(OH)—. Conjugate groups are in bold.

The structure of GalNAc₃-3$_a$ was shown previously in Example 39. The structure of GalNAc₃-17a was shown previously in Example 68, and the structure of GalNAc₃-18a was shown in Example 69.

Treatment

Six to eight week old C57BL/6 mice (Jackson Laboratory, Bar Harbor, Me.) were injected subcutaneously once at the dosage shown below with an oligonucleotide listed in Table 60 or with saline. Each treatment group consisted of 4 animals. The mice were sacrificed 72 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 61, treatment with antisense oligonucleotides lowered SRB-1 mRNA levels in a dose-dependent manner. The antisense oligonucleotides comprising a GalNAc conjugate showed similar potencies and were significantly more potent than the parent oligonucleotide lacking a GalNAc conjugate.

TABLE 61

SRB-1 mRNA (% Saline)

| ISIS No. | Dosage (mg/kg) | SRB-1 mRNA (% Saline) | GalNAc₃ Cluster | CM |
|---|---|---|---|---|
| Saline | n/a | 100.0 | n/a | n/a |
| 353382 | 3 | 79.38 | n/a | n/a |
|  | 10 | 68.67 |  |  |
|  | 30 | 40.70 |  |  |
| 661161 | 0.5 | 79.18 | GalNAc₃-3a | A$_d$ |
|  | 1.5 | 75.96 |  |  |
|  | 5 | 30.53 |  |  |
|  | 15 | 12.52 |  |  |
| 666904 | 0.5 | 91.30 | GalNAc₃-3a | PO |
|  | 1.5 | 57.88 |  |  |
|  | 5 | 21.22 |  |  |
|  | 15 | 16.49 |  |  |
| 675441 | 0.5 | 76.71 | GalNAc₃-17a | A$_d$ |
|  | 1.5 | 63.63 |  |  |
|  | 5 | 29.57 |  |  |
|  | 15 | 13.49 |  |  |
| 675442 | 0.5 | 95.03 | GalNAc₃-18a | A$_d$ |
|  | 1.5 | 60.06 |  |  |
|  | 5 | 31.04 |  |  |
|  | 15 | 19.40 |  |  |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group (data not shown). ALTs, ASTs, total bilirubin and BUN values are shown in Table 62 below.

TABLE 62

| ISIS No. | Dosage (mg/kg) | ALT (U/L) | AST (U/L) | Total Bilirubin (mg/dL) | BUN (mg/dL) | GalNAc₃ Cluster | CM |
|---|---|---|---|---|---|---|---|
| Saline | n/a | 26 | 59 | 0.16 | 42 | n/a | n/a |
| 353382 | 3 | 23 | 58 | 0.18 | 39 | n/a | n/a |
|  | 10 | 28 | 58 | 0.16 | 43 |  |  |
|  | 30 | 20 | 48 | 0.12 | 34 |  |  |
| 661161 | 0.5 | 30 | 47 | 0.13 | 35 | GalNAc₃-3a | A$_d$ |
|  | 1.5 | 23 | 53 | 0.14 | 37 |  |  |
|  | 5 | 26 | 48 | 0.15 | 39 |  |  |
|  | 15 | 32 | 57 | 0.15 | 42 |  |  |
| 666904 | 0.5 | 24 | 73 | 0.13 | 36 | GalNAc₃-3a | PO |
|  | 1.5 | 21 | 48 | 0.12 | 32 |  |  |
|  | 5 | 19 | 49 | 0.14 | 33 |  |  |
|  | 15 | 20 | 52 | 0.15 | 26 |  |  |
| 675441 | 0.5 | 42 | 148 | 0.21 | 36 | GalNAc₃-17a | A$_d$ |
|  | 1.5 | 60 | 95 | 0.16 | 34 |  |  |
|  | 5 | 27 | 75 | 0.14 | 37 |  |  |
|  | 15 | 24 | 61 | 0.14 | 36 |  |  |
| 675442 | 0.5 | 26 | 65 | 0.15 | 37 | GalNAc₃-18a | A$_d$ |
|  | 1.5 | 25 | 64 | 0.15 | 43 |  |  |
|  | 5 | 27 | 69 | 0.15 | 37 |  |  |
|  | 15 | 30 | 84 | 0.14 | 37 |  |  |

Example 75

Pharmacokinetic Analysis of Oligonucleotides Comprising a 5'-Conjugate Group The PK of the ASOs in Tables 54, 57 and 60 above was evaluated using liver samples that were obtained following the treatment procedures described in Examples 65, 66, and 74. The liver samples were minced and extracted using standard protocols and analyzed by IP-HPLC-MS alongside an internal standard. The combined tissue level (μg/g) of all metabolites was measured by integrating the appropriate UV peaks, and the tissue level of the full-length ASO missing the conjugate ("parent," which is Isis No. 353382 in this case) was measured using the appropriate extracted ion chromatograms (EIC).

TABLE 63

| | | PK Analysis in Liver | | | |
|---|---|---|---|---|---|
| ISIS No. | Dosage (mg/kg) | Total Tissue Level by UV (μg/g) | Parent ASO Tissue Level by EIC (μg/g) | GalNAc$_3$ Cluster | CM |
| 353382 | 3 | 8.9 | 8.6 | n/a | n/a |
| | 10 | 22.4 | 21.0 | | |
| | 30 | 54.2 | 44.2 | | |
| 661161 | 5 | 32.4 | 20.7 | GalNAc$_3$-3a | A$_d$ |
| | 15 | 63.2 | 44.1 | | |
| 671144 | 5 | 20.5 | 19.2 | GalNAc$_3$-12a | A$_d$ |
| | 15 | 48.6 | 41.5 | | |
| 670061 | 5 | 31.6 | 28.0 | GalNAc$_3$-13a | A$_d$ |
| | 15 | 67.6 | 55.5 | | |
| 671261 | 5 | 19.8 | 16.8 | GalNAc$_3$-14a | A$_d$ |
| | 15 | 64.7 | 49.1 | | |
| 671262 | 5 | 18.5 | 7.4 | GalNAc$_3$-15a | A$_d$ |
| | 15 | 52.3 | 24.2 | | |
| 670699 | 5 | 16.4 | 10.4 | GalNAc$_3$-3a | T$_d$ |
| | 15 | 31.5 | 22.5 | | |
| 670700 | 5 | 19.3 | 10.9 | GalNAc$_3$-3a | A$_e$ |
| | 15 | 38.1 | 20.0 | | |
| 670701 | 5 | 21.8 | 8.8 | GalNAc$_3$-3a | T$_e$ |
| | 15 | 35.2 | 16.1 | | |
| 671165 | 5 | 27.1 | 26.5 | GalNAc$_3$-13a | A$_d$ |
| | 15 | 48.3 | 44.3 | | |
| 666904 | 5 | 30.8 | 24.0 | GalNAc$_3$-3a | PO |
| | 15 | 52.6 | 37.6 | | |
| 675441 | 5 | 25.4 | 19.0 | GalNAc$_3$-17a | A$_d$ |
| | 15 | 54.2 | 42.1 | | |
| 675442 | 5 | 22.2 | 20.7 | GalNAc$_3$-18a | A$_d$ |
| | 15 | 39.6 | 29.0 | | |

The results in Table 63 above show that there were greater liver tissue levels of the oligonucleotides comprising a GalNAc$_3$ conjugate group than of the parent oligonucleotide that does not comprise a GalNAc$_3$ conjugate group (ISIS 353382) 72 hours following oligonucleotide administration, particularly when taking into consideration the differences in dosing between the oligonucleotides with and without a GalNAc$_3$ conjugate group. Furthermore, by 72 hours, 40-98% of each oligonucleotide comprising a GalNAc$_3$ conjugate group was metabolized to the parent compound, indicating that the GalNAc$_3$ conjugate groups were cleaved from the oligonucleotides.

Example 76

Preparation of Oligomeric Compound 230 Comprising GalNAc$_3$-23

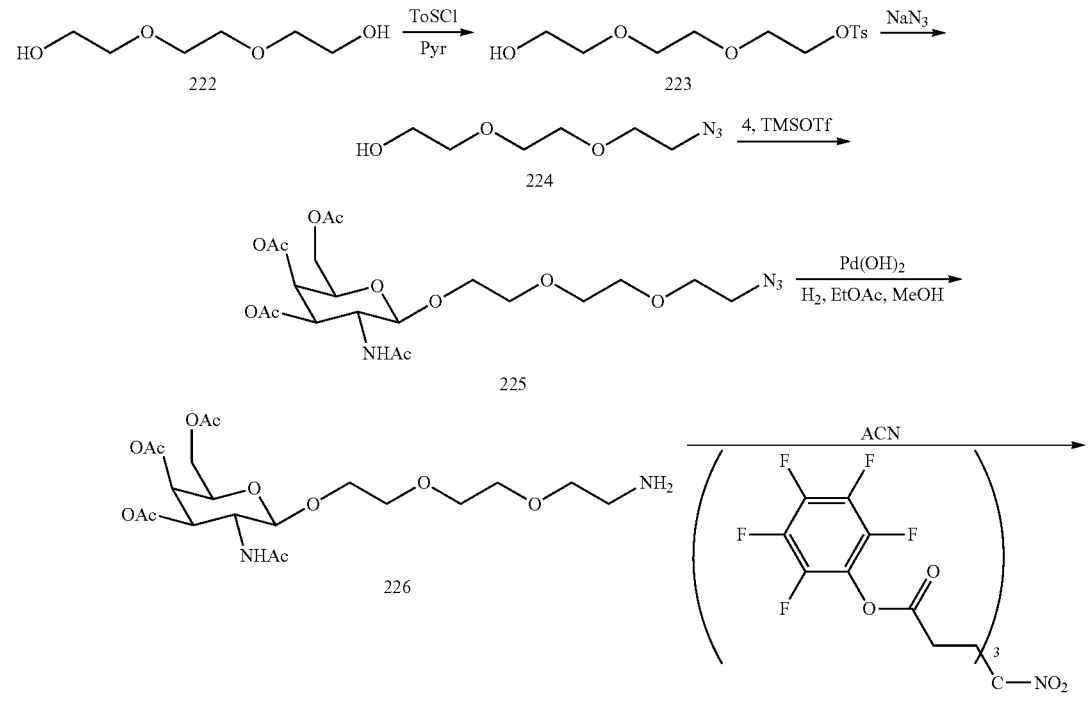

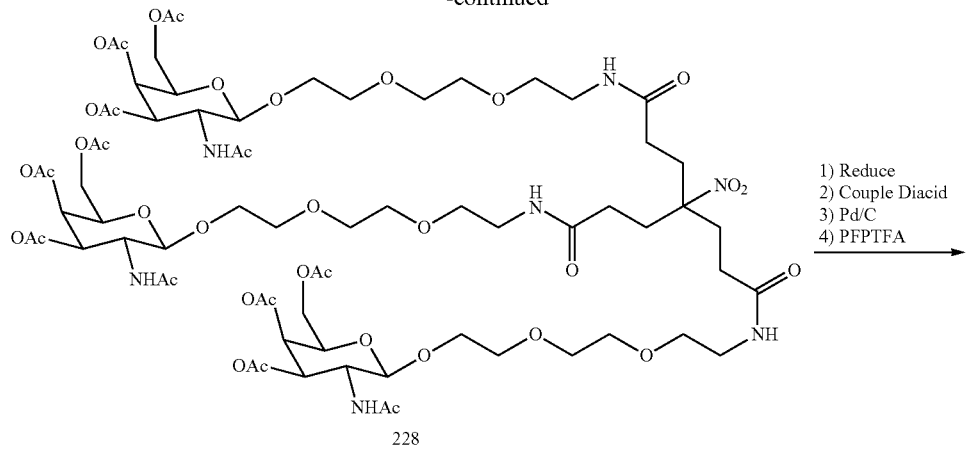

228

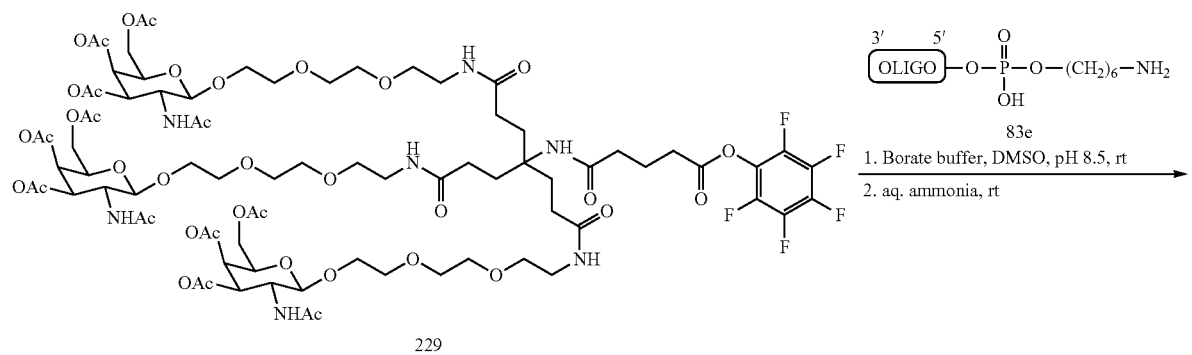

229

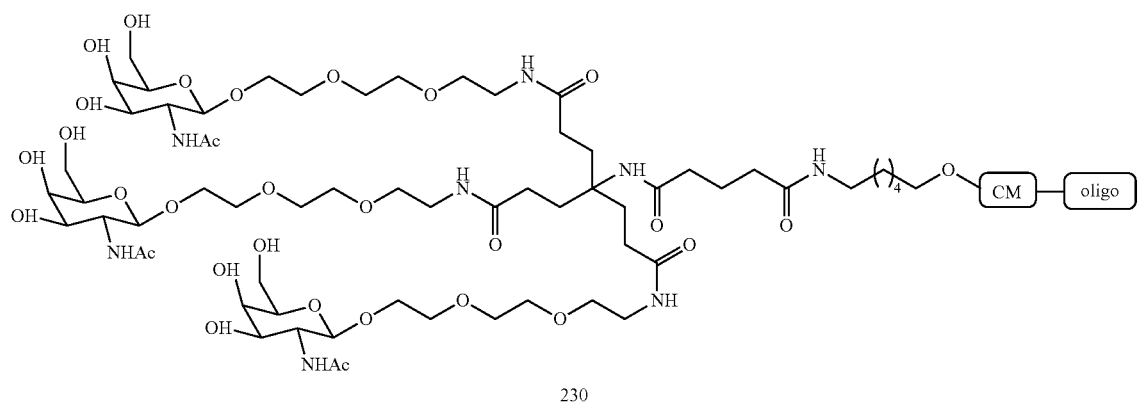

230

Compound 222 is commercially available. 44.48 ml (0.33 mol) of compound 222 was treated with tosyl chloride (25.39 g, 0.13 mol) in pyridine (500 mL) for 16 hours. The reaction was then evaporated to an oil, dissolved in EtOAc and washed with water, sat. NaHCO$_3$, brine, and dried over Na$_2$SO$_4$. The ethyl acetate was concentrated to dryness and purified by column chromatography, eluted with EtOAc/hexanes (1:1) followed by 10% methanol in CH$_2$Cl$_2$ to give compound 223 as a colorless oil. LCMS and NMR were consistent with the structure. 10 g (32.86 mmol) of 1-Tosyltriethylene glycol (compound 223) was treated with sodium azide (10.68 g, 164.28 mmol) in DMSO (100 mL) at room temperature for 17 hours. The reaction mixture was then poured onto water, and extracted with EtOAc. The organic layer was washed with water three times and dried over Na$_2$SO$_4$. The organic layer was concentrated to dryness to give 5.3 g of compound 224 (92%). LCMS and NMR were consistent with the structure. 1-Azidotriethylene glycol (compound 224, 5.53 g, 23.69 mmol) and compound 4 (6 g, 18.22 mmol) were treated with 4 A molecular sieves (5 g), and TMSOTf (1.65 ml, 9.11 mmol) in dichloromethane (100 mL) under an inert atmosphere. After 14 hours, the reaction was filtered to remove the sieves, and the organic layer was washed with sat. NaHCO$_3$, water, brine, and dried over Na$_2$SO$_4$. The organic layer was concentrated to dryness and purified by column chromatography, eluted with a gradient of 2 to 4% methanol in dichloromethane to give compound 225. LCMS and NMR were consistent with the structure. Compound 225 (11.9 g, 23.59 mmol) was hydrogenated in EtOAc/Methanol (4:1, 250 mL) over Pearlman's catalyst. After 8 hours, the catalyst was removed by filtration and the solvents removed to dryness to give compound 226. LCMS and NMR were consistent with the structure.

In order to generate compound 227, a solution of nitromethanetrispropionic acid (4.17 g, 15.04 mmol) and Hunig's base (10.3 ml, 60.17 mmol) in DMF (100 mL) were treated dropwise with pentaflourotrifluoro acetate (9.05 ml, 52.65 mmol). After 30 minutes, the reaction was poured onto ice water and extracted with EtOAc. The organic layer was washed with water, brine, and dried over Na$_2$SO$_4$. The organic layer was concentrated to dryness and then recrystallized from heptane to give compound 227 as a white solid. LCMS and NMR were consistent with the structure. Compound 227 (1.5 g, 1.93 mmol) and compound 226 (3.7 g, 7.74 mmol) were stirred at room temperature in acetonitrile (15 mL) for 2 hours. The reaction was then evaporated to dryness and purified by column chromatography, eluting with a gradient of 2 to 10% methanol in dichloromethane to give compound 228. LCMS and NMR were consistent with the structure. Compound 228 (1.7 g, 1.02 mmol) was treated with Raney Nickel (about 2 g wet) in ethanol (100 mL) in an atmosphere of hydrogen. After 12 hours, the catalyst was removed by filtration and the organic layer was evaporated to a solid that was used directly in the next step. LCMS and NMR were consistent with the structure. This solid (0.87 g, 0.53 mmol) was treated with benzylglutaric acid (0.18 g, 0.8 mmol), HBTU (0.3 g, 0.8 mmol) and DIEA (273.7 µl, 1.6 mmol) in DMF (5 mL). After 16 hours, the DMF was removed under reduced pressure at 65° C. to an oil, and the oil was dissolved in dichloromethane. The organic layer was washed with sat. NaHCO$_3$, brine, and dried over Na$_2$SO$_4$. After evaporation of the organic layer, the compound was purified by column chromatography and eluted with a gradient of 2 to 20% methanol in dichloromethane to give the coupled product. LCMS and NMR were consistent with the structure. The benzyl ester was deprotected with Pearlman's catalyst under a hydrogen atmosphere for 1 hour. The catalyst was them removed by filtration and the solvents removed to dryness to give the acid. LCMS and NMR were consistent with the structure. The acid (486 mg, 0.27 mmol) was dissolved in dry DMF (3 mL). Pyridine (53.61 µl, 0.66 mmol) was added and the reaction was purged with argon. Pentaflourotriflouro acetate (46.39 µl, 0.4 mmol) was slowly added to the reaction mixture. The color of the reaction changed from pale yellow to burgundy, and gave off a light smoke which was blown away with a stream of argon. The reaction was allowed to stir at room temperature for one hour (completion of reaction was confirmed by LCMS). The solvent was removed under reduced pressure (rotovap) at 70° C. The residue was diluted with DCM and washed with 1N NaHSO$_4$, brine, saturated sodium bicarbonate and brine again. The organics were dried over Na$_2$SO$_4$, filtered, and were concentrated to dryness to give 225 mg of compound 229 as a brittle yellow foam. LCMS and NMR were consistent with the structure.

Oligomeric compound 230, comprising a GalNAc$_3$-23 conjugate group, was prepared from compound 229 using the general procedure illustrated in Example 46. The GalNAc$_3$ cluster portion of the GalNAc$_3$-23 conjugate group (GalNAc$_3$-23$_a$) can be combined with any cleavable moiety to provide a variety of conjugate groups. The structure of GalNAc$_3$-23 (GalNAc$_3$-23$_a$-CM) is shown below:

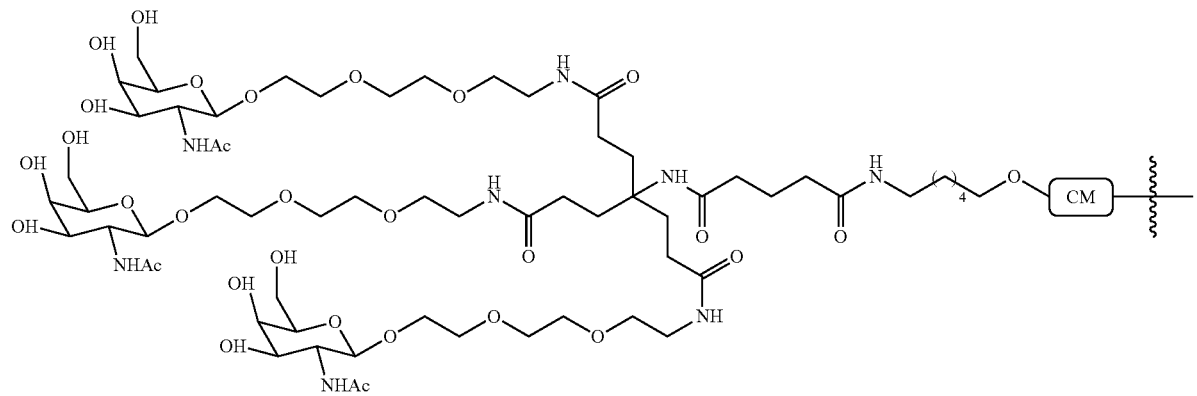

Example 77

Antisense Inhibition In Vivo by Oligonucleotides Targeting SRB-1 Comprising a GalNAc$_3$ Conjugate The oligonucleotides listed below were tested in a dose-dependent study for antisense inhibition of SRB-1 in mice.

TABLE 64

Modified ASOs targeting SRB-1

| ISIS No. | Sequences (5' to 3') | GalNAc₃ Cluster | CM | SEQ ID No. |
|---|---|---|---|---|
| 661161 | GalNAc₃-3ₐ-ₒ,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{es}$$^m$C$_{es}$$^m$C$_{es}$T$_{es}$T$_e$ | GalNAc₃-3a | A$_d$ | 2306 |
| 666904 | GalNAc₃-3ₐ-ₒ,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{es}$$^m$C$_{es}$$^m$C$_{es}$T$_{es}$T$_e$ | GalNAc₃-3a | PO | 2304 |
| 673502 | GalNAc₃-10ₐ-ₒ,A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{eo}$$^m$C$_{eo}$$^m$C$_{es}$T$_{es}$T$_e$ | GalNAc₃-10a | A$_d$ | 2306 |
| 677844 | GalNAc₃-9ₐ-ₒ,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{es}$$^m$C$_{es}$$^m$C$_{es}$T$_{es}$T$_e$ | GalNAc₃-9a | A$_d$ | 2306 |
| 677843 | GalNAc₃-23ₐ-ₒ,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{es}$$^m$C$_{es}$$^m$C$_{es}$T$_{es}$T$_e$ | GalNAc₃-23a | A$_d$ | 2306 |
| 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$ $^m$C$_{es}$T$_{es}$T$_e$A$_{do}$,-GalNAc₃-1ₐ | GalNAc₃-1a | A$_d$ | 2305 |
| 677841 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$ $^m$C$_{es}$T$_{es}$T$_e$A$_{do}$,-GalNAc₃-19ₐ | GalNAc₃-19a | A$_d$ | 2305 |
| 677842 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$ $^m$C$_{es}$T$_{es}$T$_e$A$_{do}$,-GalNAc₃-20ₐ | GalNAc₃-20a | A$_d$ | 2305 |

The structure of GalNAc₃-1$_a$ was shown previously in Example 9, GalNAc₃-3$_a$ was shown in Example 39, GalNAc₃-9a was shown in Example 52, GalNAc₃-10a was shown in Example 46, GalNAc₃-19$_a$ was shown in Example 70, GalNAc₃-20$_a$ was shown in Example 71, and GalNAc₃-23$_a$ was shown in Example 76.

Treatment

Six to eight week old C57BL/6 mice (Jackson Laboratory, Bar Harbor, Me.) were each injected subcutaneously once at a dosage shown below with an oligonucleotide listed in Table 64 or with saline. Each treatment group consisted of 4 animals. The mice were sacrificed 72 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 65, treatment with antisense oligonucleotides lowered SRB-1 mRNA levels in a dose-dependent manner

TABLE 65

SRB-1 mRNA (% Saline)

| ISIS No. | Dosage (mg/kg) | SRB-1 mRNA (% Saline) | GalNAc₃ Cluster | CM |
|---|---|---|---|---|
| Saline | n/a | 100.0 | n/a | n/a |
| 661161 | 0.5 | 89.18 | GalNAc₃-3a | A$_d$ |
|  | 1.5 | 77.02 |  |  |
|  | 5 | 29.10 |  |  |
|  | 15 | 12.64 |  |  |
| 666904 | 0.5 | 93.11 | GalNAc₃-3a | PO |
|  | 1.5 | 55.85 |  |  |
|  | 5 | 21.29 |  |  |
|  | 15 | 13.43 |  |  |
| 673502 | 0.5 | 77.75 | GalNAc₃-10a | A$_d$ |
|  | 1.5 | 41.05 |  |  |
|  | 5 | 19.27 |  |  |
|  | 15 | 14.41 |  |  |
| 677844 | 0.5 | 87.65 | GalNAc₃-9a | A$_d$ |
|  | 1.5 | 93.04 |  |  |
|  | 5 | 40.77 |  |  |
|  | 15 | 16.95 |  |  |
| 677843 | 0.5 | 102.28 | GalNAc₃-23a | A$_d$ |
|  | 1.5 | 70.51 |  |  |
|  | 5 | 30.68 |  |  |
|  | 15 | 13.26 |  |  |
| 655861 | 0.5 | 79.72 | GalNAc₃-1a | A$_d$ |
|  | 1.5 | 55.48 |  |  |
|  | 5 | 26.99 |  |  |
|  | 15 | 17.58 |  |  |
| 677841 | 0.5 | 67.43 | GalNAc₃-19a | A$_d$ |
|  | 1.5 | 45.13 |  |  |
|  | 5 | 27.02 |  |  |
|  | 15 | 12.41 |  |  |
| 677842 | 0.5 | 64.13 | GalNAc₃-20a | A$_d$ |
|  | 1.5 | 53.56 |  |  |
|  | 5 | 20.47 |  |  |
|  | 15 | 10.23 |  |  |

Liver transaminase levels, alanine aminotransferase (ALT) and aspartate aminotransferase (AST), in serum were also measured using standard protocols. Total bilirubin and BUN were also evaluated. Changes in body weights were evaluated, with no significant change from the saline group (data not shown). ALTs, ASTs, total bilirubin and BUN values are shown in Table 66 below.

TABLE 66

| ISIS No. | Dosage (mg/kg) | ALT (U/L) | AST (U/L) | Total Bilirubin (mg/dL) | BUN (mg/dL) | GalNAc₃ Cluster | CM |
|---|---|---|---|---|---|---|---|
| Saline | n/a | 21 | 45 | 0.13 | 34 | n/a | n/a |
| 661161 | 0.5 | 28 | 51 | 0.14 | 39 | GalNAc₃-3a | $A_d$ |
|  | 1.5 | 23 | 42 | 0.13 | 39 |  |  |
|  | 5 | 22 | 59 | 0.13 | 37 |  |  |
|  | 15 | 21 | 56 | 0.15 | 35 |  |  |
| 666904 | 0.5 | 24 | 56 | 0.14 | 37 | GalNAc₃-3a | PO |
|  | 1.5 | 26 | 68 | 0.15 | 35 |  |  |
|  | 5 | 23 | 77 | 0.14 | 34 |  |  |
|  | 15 | 24 | 60 | 0.13 | 35 |  |  |
| 673502 | 0.5 | 24 | 59 | 0.16 | 34 | GalNAc₃-10a | $A_d$ |
|  | 1.5 | 20 | 46 | 0.17 | 32 |  |  |
|  | 5 | 24 | 45 | 0.12 | 31 |  |  |
|  | 15 | 24 | 47 | 0.13 | 34 |  |  |
| 677844 | 0.5 | 25 | 61 | 0.14 | 37 | GalNAc₃-9a | $A_d$ |
|  | 1.5 | 23 | 64 | 0.17 | 33 |  |  |
|  | 5 | 25 | 58 | 0.13 | 35 |  |  |
|  | 15 | 22 | 65 | 0.14 | 34 |  |  |
| 677843 | 0.5 | 53 | 53 | 0.13 | 35 | GalNAc₃-23a | $A_d$ |
|  | 1.5 | 25 | 54 | 0.13 | 34 |  |  |
|  | 5 | 21 | 60 | 0.15 | 34 |  |  |
|  | 15 | 22 | 43 | 0.12 | 38 |  |  |
| 655861 | 0.5 | 21 | 48 | 0.15 | 33 | GalNAc₃-1a | $A_d$ |
|  | 1.5 | 28 | 54 | 0.12 | 35 |  |  |
|  | 5 | 22 | 60 | 0.13 | 36 |  |  |
|  | 15 | 21 | 55 | 0.17 | 30 |  |  |
| 677841 | 0.5 | 32 | 54 | 0.13 | 34 | GalNAc₃-19a | $A_d$ |
|  | 1.5 | 24 | 56 | 0.14 | 34 |  |  |
|  | 5 | 23 | 92 | 0.18 | 31 |  |  |
|  | 15 | 24 | 58 | 0.15 | 31 |  |  |
| 677842 | 0.5 | 23 | 61 | 0.15 | 35 | GalNAc₃-20a | $A_d$ |
|  | 1.5 | 24 | 57 | 0.14 | 34 |  |  |
|  | 5 | 41 | 62 | 0.15 | 35 |  |  |
|  | 15 | 24 | 37 | 0.14 | 32 |  |  |

Example 78

Antisense Inhibition In Vivo by Oligonucleotides Targeting Angiotensinogen Comprising a GalNAc₃ Conjugate The oligonucleotides listed below were tested in a dose-dependent study for antisense inhibition of Angiotensinogen (AGT) in normotensive Sprague Dawley rats.

TABLE 67

Modified ASOs targeting AGT

| ISIS No. | Sequences (5' to 3') | GalNAc₃ Cluster | CM | SEQ ID No. |
|---|---|---|---|---|
| 552668 | $^mC_{es}A_{es}{}^mC_{es}T_{es}G_{es}A_{ds}T_{ds}T_{ds}T_{ds}T_{ds}T_{ds}G_{ds}{}^mC_{ds}{}^mC_{ds}{}^mC_{ds}A_{es}G_{es}G_{es}A_{es}T_e$ | n/a | n/a | 2310 |
| 669509 | $^mC_{es}A_{es}{}^mC_{es}T_{es}G_{es}A_{ds}T_{ds}T_{ds}T_{ds}T_{ds}T_{ds}G_{ds}{}^mC_{ds}{}^mC_{ds}{}^mC_{ds}A_{es}G_{es}G_{es}A_{es}T_{eo}A_{do}$,-GalNAc₃-1$_a$ | GalNAc₃-1$_a$ | $A_d$ | 2311 |

The structure of GalNAc₃-1$_a$ was shown previously in Example 9.

Treatment

Six week old, male Sprague Dawley rats were each injected subcutaneously once per week at a dosage shown below, for a total of three doses, with an oligonucleotide listed in Table 67 or with PBS. Each treatment group consisted of 4 animals. The rats were sacrificed 72 hours following the final dose. AGT liver mRNA levels were measured using real-time PCR and RIBOGREEN® RNA quantification reagent (Molecular Probes, Inc. Eugene, Oreg.) according to standard protocols. AGT plasma protein levels were measured using the Total Angiotensinogen ELISA (Catalog # JP27412, IBL International, Toronto, ON) with plasma diluted 1:20,000. The results below are presented as the average percent of AGT mRNA levels in liver or AGT protein levels in plasma for each treatment group, normalized to the PBS control.

As illustrated in Table 68, treatment with antisense oligonucleotides lowered AGT liver mRNA and plasma protein levels in a dose-dependent manner, and the oligonucleotide comprising a GalNAc conjugate was significantly more potent than the parent oligonucleotide lacking a GalNAc conjugate.

TABLE 68

AGT liver mRNA and plasma protein levels

| ISIS No. | Dosage (mg/kg) | AGT liver mRNA (% PBS) | AGT plasma protein (% PBS) | GalNAc$_3$ Cluster | CM |
|---|---|---|---|---|---|
| PBS | n/a | 100 | 100 | n/a | n/a |
| 552668 | 3 | 95 | 122 | n/a | n/a |
|  | 10 | 85 | 97 |  |  |
|  | 30 | 46 | 79 |  |  |
|  | 90 | 8 | 11 |  |  |
| 669509 | 0.3 | 95 | 70 | GalNAc$_3$-1a | A$_d$ |
|  | 1 | 95 | 129 |  |  |
|  | 3 | 62 | 97 |  |  |
|  | 10 | 9 | 23 |  |  |

Liver transaminase levels, alanine aminotransferase (ALT) and aspartate aminotransferase (AST), in plasma and body weights were also measured at time of sacrifice using standard protocols. The results are shown in Table 69 below.

TABLE 69

Liver transaminase levels and rat body weights

| ISIS No. | Dosage (mg/kg) | ALT (U/L) | AST (U/L) | Body Weight (% of baseline) | GalNAc$_3$ Cluster | CM |
|---|---|---|---|---|---|---|
| PBS | n/a | 51 | 81 | 186 | n/a | n/a |
| 552668 | 3 | 54 | 93 | 183 | n/a | n/a |
|  | 10 | 51 | 93 | 194 |  |  |
|  | 30 | 59 | 99 | 182 |  |  |
|  | 90 | 56 | 78 | 170 |  |  |
| 669509 | 0.3 | 53 | 90 | 190 | GalNAc$_3$-1a | A$_d$ |
|  | 1 | 51 | 93 | 192 |  |  |
|  | 3 | 48 | 85 | 189 |  |  |
|  | 10 | 56 | 95 | 189 |  |  |

Example 79

Duration of Action In Vivo of Oligonucleotides Targeting APOC-III Comprising a GalNAc$_3$ Conjugate The oligonucleotides listed in Table 70 below were tested in a single dose study for duration of action in mice.

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, and GalNAc$_3$-13$_a$ was shown in Example 62.

Treatment

Six to eight week old transgenic mice that express human APOC-III were each injected subcutaneously once with an oligonucleotide listed in Table 70 or with PBS. Each treatment group consisted of 3 animals. Blood was drawn before dosing to determine baseline and at 72 hours, 1 week, 2 weeks, 3 weeks, 4 weeks, 5 weeks, and 6 weeks following the dose. Plasma triglyceride and APOC-III protein levels were measured as described in Example 20. The results below are presented as the average percent of plasma triglyceride and APOC-III levels for each treatment group, normalized to baseline levels, showing that the oligonucleotides comprising a GalNAc conjugate group exhibited a longer duration of action than the parent oligonucleotide without a conjugate group (ISIS 304801) even though the dosage of the parent was three times the dosage of the oligonucleotides comprising a GalNAc conjugate group.

TABLE 70

Modified ASOs targeting APOC-III

| ISIS No. | Sequences (5' to 3') | GalNAc$_3$ Cluster | CM | SEQ ID No. |
|---|---|---|---|---|
| 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | n/a | n/a | 2296 |
| 647535 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_{eo}$A$_{do}$'-GalNAc$_3$-1$_a$ | GalNAc$_3$-1a | A$_d$ | 2297 |
| 663083 | GalNAc$_3$-3$_{a^-o}$,A$_{do}$A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | GalNAc$_3$-3a | A$_d$ | 2312 |
| 674449 | GalNAc$_3$-7$_{a^-o}$,A$_{do}$A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | GalNAc$_3$-7a | A$_d$ | 2312 |
| 674450 | GalNAc$_3$-10$_{a^-o}$,A$_{do}$A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | GalNAc$_3$-10a | A$_d$ | 2312 |
| 674451 | GalNAc$_3$-13$_{a^-o}$,A$_{do}$A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | GalNAc$_3$-13a | A$_d$ | 2312 |

TABLE 71

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc$_3$ Cluster | CM |
|---|---|---|---|---|---|---|
| PBS | n/a | 3 | 97 | 102 | n/a | n/a |
| | | 7 | 101 | 98 | | |
| | | 14 | 108 | 98 | | |
| | | 21 | 107 | 107 | | |
| | | 28 | 94 | 91 | | |
| | | 35 | 88 | 90 | | |
| | | 42 | 91 | 105 | | |
| 304801 | 30 | 3 | 40 | 34 | n/a | n/a |
| | | 7 | 41 | 37 | | |
| | | 14 | 50 | 57 | | |
| | | 21 | 50 | 50 | | |
| | | 28 | 57 | 73 | | |
| | | 35 | 68 | 70 | | |
| | | 42 | 75 | 93 | | |
| 647535 | 10 | 3 | 36 | 37 | GalNAc$_3$-1a | A$_d$ |
| | | 7 | 39 | 47 | | |
| | | 14 | 40 | 45 | | |
| | | 21 | 41 | 41 | | |
| | | 28 | 42 | 62 | | |
| | | 35 | 69 | 69 | | |
| | | 42 | 85 | 102 | | |
| 663083 | 10 | 3 | 24 | 18 | GalNAc$_3$-3a | A$_d$ |
| | | 7 | 28 | 23 | | |
| | | 14 | 25 | 27 | | |
| | | 21 | 28 | 28 | | |
| | | 28 | 37 | 44 | | |
| | | 35 | 55 | 57 | | |
| | | 42 | 60 | 78 | | |
| 674449 | 10 | 3 | 29 | 26 | GalNAc$_3$-7a | A$_d$ |
| | | 7 | 32 | 31 | | |
| | | 14 | 38 | 41 | | |
| | | 21 | 44 | 44 | | |
| | | 28 | 53 | 63 | | |
| | | 35 | 69 | 77 | | |
| | | 42 | 78 | 99 | | |
| 674450 | 10 | 3 | 33 | 30 | GalNAc$_3$-10a | A$_d$ |
| | | 7 | 35 | 34 | | |
| | | 14 | 31 | 34 | | |
| | | 21 | 44 | 44 | | |
| | | 28 | 56 | 61 | | |
| | | 35 | 68 | 70 | | |
| | | 42 | 83 | 95 | | |
| 674451 | 10 | 3 | 35 | 33 | GalNAc$_3$-13a | A$_d$ |
| | | 7 | 24 | 32 | | |
| | | 14 | 40 | 34 | | |
| | | 21 | 48 | 48 | | |
| | | 28 | 54 | 67 | | |
| | | 35 | 65 | 75 | | |
| | | 42 | 74 | 97 | | |

Example 80

Antisense Inhibition In Vivo by Oligonucleotides Targeting Alpha-1 Antitrypsin (A1AT) Comprising a GalNAc$_3$ Conjugate The oligonucleotides listed in Table 72 below were tested in a study for dose-dependent inhibition of A1AT in mice.

TABLE 72

Modified ASOs targeting A1AT

| ISIS No. | Sequences (5' to 3') | GalNAc$_3$ Cluster | CM | SEQ ID No. |
|---|---|---|---|---|
| 476366 | A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | n/a | n/a | 2313 |

TABLE 72-continued

Modified ASOs targeting A1AT

| ISIS No. | Sequences (5' to 3') | GalNAc$_3$ Cluster | CM | SEQ ID No. |
|---|---|---|---|---|
| 656326 | A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_{eo}$A$_{do}$,-GalNAc$_3$-1$_a$ | GalNAc$_3$-1a | A$_d$ | 2314 |
| 678381 | GalNAc$_3$-3$_a$-$_o$,A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-3a | A$_d$ | 2315 |
| 678382 | GalNAc$_3$-7$_a$-$_o$,A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-7a | A$_d$ | 2315 |
| 678383 | GalNAc$_3$-10$_a$-$_o$,A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-10a | A$_d$ | 2315 |
| 678384 | GalNAc$_3$-13$_a$-$_o$,A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-13a | A$_d$ | 2315 |

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, and GalNAc$_3$-13$_a$ was shown in Example 62.

Treatment

Six week old, male C57BL/6 mice (Jackson Laboratory, Bar Harbor, Me.) were each injected subcutaneously once per week at a dosage shown below, for a total of three doses, with an oligonucleotide listed in Table 72 or with PBS. Each treatment group consisted of 4 animals. The mice were sacrificed 72 hours following the final administration. A1AT liver mRNA levels were determined using real-time PCR and RIBOGREEN® RNA quantification reagent (Molecular Probes, Inc. Eugene, Oreg.) according to standard protocols. A1AT plasma protein levels were determined using the Mouse Alpha 1-Antitrypsin ELISA (catalog #41-A1AMS-E01, Alpco, Salem, N.H.). The results below are presented as the average percent of A1AT liver mRNA and plasma protein levels for each treatment group, normalized to the PBS control.

As illustrated in Table 73, treatment with antisense oligonucleotides lowered A1AT liver mRNA and A1AT plasma protein levels in a dose-dependent manner. The oligonucleotides comprising a GalNAc conjugate were significantly more potent than the parent (ISIS 476366).

TABLE 73

A1AT liver mRNA and plasma protein levels

| ISIS No. | Dosage (mg/kg) | A1AT liver mRNA (% PBS) | A1AT plasma protein (% PBS) | GalNAc$_3$ Cluster | CM |
|---|---|---|---|---|---|
| PBS | n/a | 100 | 100 | n/a | n/a |
| 476366 | 5 | 86 | 78 | n/a | n/a |
|  | 15 | 73 | 61 |  |  |
|  | 45 | 30 | 38 |  |  |
| 656326 | 0.6 | 99 | 90 | GalNAc$_3$-1a | A$_d$ |
|  | 2 | 61 | 70 |  |  |
|  | 6 | 15 | 30 |  |  |
|  | 18 | 6 | 10 |  |  |
| 678381 | 0.6 | 105 | 90 | GalNAc$_3$-3a | A$_d$ |
|  | 2 | 53 | 60 |  |  |
|  | 6 | 16 | 20 |  |  |
|  | 18 | 7 | 13 |  |  |
| 678382 | 0.6 | 90 | 79 | GalNAc$_3$-7a | A$_d$ |
|  | 2 | 49 | 57 |  |  |
|  | 6 | 21 | 27 |  |  |
|  | 18 | 8 | 11 |  |  |
| 678383 | 0.6 | 94 | 84 | GalNAc$_3$-10a | A$_d$ |
|  | 2 | 44 | 53 |  |  |
|  | 6 | 13 | 24 |  |  |
|  | 18 | 6 | 10 |  |  |
| 678384 | 0.6 | 106 | 91 | GalNAc$_3$-13a | A$_d$ |
|  | 2 | 65 | 59 |  |  |
|  | 6 | 26 | 31 |  |  |
|  | 18 | 11 | 15 |  |  |

Liver transaminase and BUN levels in plasma were measured at time of sacrifice using standard protocols. Body weights and organ weights were also measured. The results are shown in Table 74 below. Body weight is shown as % relative to baseline. Organ weights are shown as % of body weight relative to the PBS control group.

TABLE 74

| ISIS No. | Dosage (mg/kg) | ALT (U/L) | AST (U/L) | BUN (mg/dL) | Body weight (% baseline) | Liver weight (Rel % BW) | Kidney weight (Rel % BW) | Spleen weight (Rel % BW) |
|---|---|---|---|---|---|---|---|---|
| PBS | n/a | 25 | 51 | 37 | 119 | 100 | 100 | 100 |
| 476366 | 5 | 34 | 68 | 35 | 116 | 91 | 98 | 106 |
|  | 15 | 37 | 74 | 30 | 122 | 92 | 101 | 128 |
|  | 45 | 30 | 47 | 31 | 118 | 99 | 108 | 123 |
| 656326 | 0.6 | 29 | 57 | 40 | 123 | 100 | 103 | 119 |
|  | 2 | 36 | 75 | 39 | 114 | 98 | 111 | 106 |
|  | 6 | 32 | 67 | 39 | 125 | 99 | 97 | 122 |
|  | 18 | 46 | 77 | 36 | 116 | 102 | 109 | 101 |
| 678381 | 0.6 | 26 | 57 | 32 | 117 | 93 | 109 | 110 |
|  | 2 | 26 | 52 | 33 | 121 | 96 | 106 | 125 |
|  | 6 | 40 | 78 | 32 | 124 | 92 | 106 | 126 |
|  | 18 | 31 | 54 | 28 | 118 | 94 | 103 | 120 |
| 678382 | 0.6 | 26 | 42 | 35 | 114 | 100 | 103 | 103 |
|  | 2 | 25 | 50 | 31 | 117 | 91 | 104 | 117 |
|  | 6 | 30 | 79 | 29 | 117 | 89 | 102 | 107 |
|  | 18 | 65 | 112 | 31 | 120 | 89 | 104 | 113 |
| 678383 | 0.6 | 30 | 67 | 38 | 121 | 91 | 100 | 123 |
|  | 2 | 33 | 53 | 33 | 118 | 98 | 102 | 121 |
|  | 6 | 32 | 63 | 32 | 117 | 97 | 105 | 105 |
|  | 18 | 36 | 68 | 31 | 118 | 99 | 103 | 108 |
| 678384 | 0.6 | 36 | 63 | 31 | 118 | 98 | 103 | 98 |
|  | 2 | 32 | 61 | 32 | 119 | 93 | 102 | 114 |
|  | 6 | 34 | 69 | 34 | 122 | 100 | 100 | 96 |
|  | 18 | 28 | 54 | 30 | 117 | 98 | 101 | 104 |

Example 81

Duration of Action In Vivo of Oligonucleotides Targeting A1AT Comprising a GalNAc$_3$ Conjugate The oligonucleotides listed in Table 72 were tested in a single dose study for duration of action in mice.

Treatment

Six week old, male C57BL/6 mice were each injected subcutaneously once with an oligonucleotide listed in Table 72 or with PBS. Each treatment group consisted of 4 animals. Blood was drawn the day before dosing to determine baseline and at 5, 12, 19, and 25 days following the dose. Plasma A1AT protein levels were measured via ELISA (see Example 80). The results below are presented as the average percent of plasma A1AT protein levels for each treatment group, normalized to baseline levels. The results show that the oligonucleotides comprising a GalNAc conjugate were more potent and had longer duration of action than the parent lacking a GalNAc conjugate (ISIS 476366). Furthermore, the oligonucleotides comprising a 5'-GalNAc conjugate (ISIS 678381, 678382, 678383, and 678384) were generally even more potent with even longer duration of action than the oligonucleotide comprising a 3'-GalNAc conjugate (ISIS 656326).

TABLE 75

Plasma A1AT protein levels in mice

| ISIS No. | Dosage (mg/kg) | Time point (days post-dose) | A1AT (% baseline) | GalNAc$_3$ Cluster | CM |
|---|---|---|---|---|---|
| PBS | n/a | 5 | 93 | n/a | n/a |
|  |  | 12 | 93 |  |  |
|  |  | 19 | 90 |  |  |
|  |  | 25 | 97 |  |  |
| 476366 | 100 | 5 | 38 | n/a | n/a |
|  |  | 12 | 46 |  |  |
|  |  | 19 | 62 |  |  |
|  |  | 25 | 77 |  |  |
| 656326 | 18 | 5 | 33 | GalNAc$_3$-1a | A$_d$ |
|  |  | 12 | 36 |  |  |
|  |  | 19 | 51 |  |  |
|  |  | 25 | 72 |  |  |
| 678381 | 18 | 5 | 21 | GalNAc$_3$-3a | A$_d$ |
|  |  | 12 | 21 |  |  |
|  |  | 19 | 35 |  |  |
|  |  | 25 | 48 |  |  |
| 678382 | 18 | 5 | 21 | GalNAc$_3$-7a | A$_d$ |
|  |  | 12 | 21 |  |  |
|  |  | 19 | 39 |  |  |
|  |  | 25 | 60 |  |  |
| 678383 | 18 | 5 | 24 | GalNAc$_3$-10a | A$_d$ |
|  |  | 12 | 21 |  |  |
|  |  | 19 | 45 |  |  |
|  |  | 25 | 73 |  |  |
| 678384 | 18 | 5 | 29 | GalNAc$_3$-13a | A$_d$ |
|  |  | 12 | 34 |  |  |
|  |  | 19 | 57 |  |  |
|  |  | 25 | 76 |  |  |

Example 82

Antisense Inhibition In Vitro by Oligonucleotides Targeting SRB-1 Comprising a GalNAc$_3$ Conjugate Primary mouse liver hepatocytes were seeded in 96 well plates at 15,000 cells/well 2 hours prior to treatment. The oligonucleotides listed in Table 76 were added at 2, 10, 50, or 250 nM in Williams E medium and cells were incubated overnight at 37° C. in 5% CO$_2$. Cells were lysed 16 hours following oligonucleotide addition, and total RNA was purified using RNease 3000 BioRobot (Qiagen). SRB-1 mRNA levels were determined using real-time PCR and RIBOGREEN® RNA quantification reagent (Molecular Probes, Inc. Eugene, Oreg.) according to standard protocols. IC$_{50}$ values were determined using Prism 4 software (Graph- Pad). The results show that oligonucleotides comprising a variety of different GalNAc conjugate groups and a variety of different cleavable moieties are significantly more potent in an in vitro free uptake experiment than the parent oligonucleotides lacking a GalNAc conjugate group (ISIS 353382 and 666841).

TABLE 76

Inhibition of SRB-1 expression in vitro

| ISIS No. | Sequence (5' to 3') | Linkages | GalNAc cluster | CM | IC$_{50}$ (nM) | SEQ ID No. |
|---|---|---|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{e}$ | PS | n/a | n/a | 250 | 2304 |
| 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{e}$T$_{eo}$A$_{do}$,-GalNAc$_3$-1$_a$ | PS | GalNAc$_3$-1$_a$ | A$_d$ | 40 | 2305 |
| 661161 | GalNAc$_3$-3$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{e}$ | PS | GalNAc$_3$-3$_a$ | A$_d$ | 40 | 2306 |
| 661162 | GalNAc$_3$-3$_a$-$_o$,A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$A$_{ds}$$^m$C$_{ds}$T$_{ds}$ T$_{eo}$$^m$C$_{eo}$$^m$C$_{es}$T$_{e}$ | PO/PS | GalNAc$_3$-3$_a$ | A$_d$ | 8 | 2306 |
| 664078 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{e}$T$_{eo}$A$_{do}$,-GalNAc$_3$-9$_a$ | PS | GalNAc$_3$-9$_a$ | A$_d$ | 20 | 2305 |
| 665001 | GalNAc$_3$-8$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$-A$_{ds}$T$_{ds}$G$_{ds}$A$_{ds}$$^m$C$_{ds}$T$_{ds}$T$_{es}$$^m$C$_{es}$$^m$C$_{es}$T$_{e}$ | PS | GalNAc$_3$-8$_a$ | A$_d$ | 70 | 2306 |
| 666224 | GalNAc$_3$-5$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{e}$ | PS | GalNAc$_3$-5$_a$ | A$_d$ | 80 | 2306 |
| 666841 | G$_{es}$$^m$C$_{eo}$T$_{eo}$T$_{eo}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{eo}$$^m$C$_{eo}$$^m$C$_{es}$T$_{es}$T$_{e}$ | PO/PS | n/a | n/a | >250 | 2304 |
| 666881 | GalNAc$_3$-10$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{e}$ | PS | GalNAc$_3$-10$_a$ | A$_d$ | 30 | 2306 |
| 666904 | GalNAc$_3$-3$_a$-$_o$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{e}$ | PS | GalNAc$_3$-3$_a$ | PO | 9 | 2304 |
| 666924 | GalNAc$_3$-3$_a$-$_o$,T$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{e}$ | PS | GalNAc$_3$-3$_a$ | T$_d$ | 15 | 2309 |
| 666961 | GalNAc$_3$-6$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{e}$ | PS | GalNAc$_3$-6$_a$ | A$_d$ | 150 | 2306 |
| 666981 | GalNAc$_3$-7$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{e}$ | PS | GalNAc$_3$-7$_a$ | A$_d$ | 20 | 2306 |
| 670061 | GalNAc$_3$-13$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{e}$ | PS | GalNAc$_3$-13$_a$ | A$_d$ | 30 | 2306 |
| 670699 | GalNAc$_3$-3$_a$-$_o$,T$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{eo}$$^m$C$_{eo}$$^m$C$_{es}$T$_{es}$T$_{e}$ | PO/PS | GalNAc$_3$-3$_a$ | T$_d$ | 15 | 2309 |
| 670700 | GalNAc$_3$-3$_a$-$_o$,A$_{e}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{eo}$$^m$C$_{eo}$$^m$C$_{es}$T$_{es}$T | PO/PS | GalNAc$_3$-3$_a$ | A$_e$ | 30 | 2306 |
| 670701 | GalNAc$_3$-3$_a$-$_o$,T$_{eo}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{eo}$$^m$C$_{eo}$$^m$C$_{es}$T$_{es}$T$_{e}$ | PO/PS | GalNAc$_3$-3$_a$ | T$_e$ | 25 | 2306 |
| 671144 | GalNAc$_3$-12$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{e}$ | PS | GalNAc$_3$-12$_a$ | A$_d$ | 40 | 2306 |
| 671165 | GalNAc$_3$-13$_a$-$_o$,A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{eo}$$^m$C$_{eo}$$^m$C$_{es}$T$_{es}$T | PO/PS | GalNAc$_3$-13$_a$ | A$_d$ | 8 | 2306 |
| 671261 | GalNAc$_3$-14$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{e}$ | PS | GalNAc$_3$-14$_a$ | A$_d$ | >250 | 2306 |
| 671262 | GalNAc$_3$-15$_a$-$_o$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{e}$ | PS | GalNAc$_3$-15$_a$ | A$_d$ | >250 | 2306 |
| 673501 | GalNAc$_3$-7$_a$-$_o$,A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_{e}$ | PO/PS | GalNAc$_3$-7$_a$ | A$_d$ | 30 | 2306 |
| 673502 | GalNAc$_3$-10$_a$-$_o$,A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{eo}$$^m$C$_{eo}$$^m$C$_{es}$T$_{es}$T$_{e}$ | PO/PS | GalNAc$_3$-10$_a$ | A$_d$ | 8 | 2306 |

TABLE 76-continued

Inhibition of SRB-1 expression in vitro

| ISIS No. | Sequence (5' to 3') | Linkages | GalNAc cluster | CM | IC$_{50}$ (nM) | SEQ ID No. |
|---|---|---|---|---|---|---|
| 675441 | GalNAc$_3$-17$_a$-$_o$,A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{es}$T$_e$ | PS | GalNAc$_3$-17$_a$ | A$_d$ | 30 | 2306 |
| 675442 | GalNAc$_3$-18$_a$-$_o$,A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{es}$T$_e$ | PS | GalNAc$_3$-18$_a$ | A$_d$ | 20 | 2306 |
| 677841 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$T$_{es}$T$_{eo}$A$_{do}$,-GalNAc$_3$-19$_a$ | PS | GalNAc$_3$-19$_a$ | A$_d$ | 40 | 2305 |
| 677842 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$T$_{es}$T$_{eo}$A$_{do}$,-GalNAc$_3$-20$_a$ | PS | GalNAc$_3$-20$_a$ | A$_d$ | 30 | 2305 |
| 677843 | GalNAc$_3$-23$_a$-$_o$,A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{es}$T$_e$ | PS | GalNAc$_3$-23$_a$ | A$_d$ | 40 | 2306 |

The structure of GalNAc$_3$-1$_a$ was shown previously in Example 9, GalNAc$_3$-3$_a$ was shown in Example 39, GalNAc$_3$-5$_a$ was shown in Example 49, GalNAc$_3$-6$_a$ was shown in Example 51, GalNAc$_3$-7$_a$ was shown in Example 48, GalNAc$_3$-8$_a$ was shown in Example 47, GalNAc$_3$-9$_a$ was shown in Example 52, GalNAc$_3$-10$_a$ was shown in Example 46, GalNAc$_3$-12$_a$ was shown in Example 61, GalNAc$_3$-13$_a$ was shown in Example 62, GalNAc$_3$-14$_a$ was shown in Example 63, GalNAc$_3$-15$_a$ was shown in Example 64, GalNAc$_3$-17$_a$ was shown in Example 68, GalNAc$_3$-18$_a$ was shown in Example 69, GalNAc$_3$-19$_a$ was shown in Example 70, GalNAc$_3$-20$_a$ was shown in Example 71, and GalNAc$_3$-23$_a$ was shown in Example 76.

Example 83

Antisense Inhibition In Vivo by Oligonucleotides Targeting Factor XI Comprising a GalNAc$_3$ Conjugate The oligonucleotides listed in Table 77 below were tested in a study for dose-dependent inhibition of Factor XI in mice.

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, and GalNAc$_3$-13$_a$ was shown in Example 62.

Treatment

Six to eight week old mice were each injected subcutaneously once per week at a dosage shown below, for a total of three doses, with an oligonucleotide listed below or with PBS. Each treatment group consisted of 4 animals. The mice were sacrificed 72 hours following the final dose. Factor XI liver mRNA levels were measured using real-time PCR and normalized to cyclophilin according to standard protocols. Liver transaminases, BUN, and bilirubin were also measured. The results below are presented as the average percent for each treatment group, normalized to the PBS control.

As illustrated in Table 78, treatment with antisense oligonucleotides lowered Factor XI liver mRNA in a dose-dependent manner. The results show that the oligonucleotides comprising a GalNAc conjugate were more potent than the parent lacking a GalNAc conjugate (ISIS 404071). Furthermore, the oligonucleotides comprising a 5'-GalNAc conjugate (ISIS 663086, 678347, 678348, and 678349) were even more potent than the oligonucleotide comprising a 3'-GalNAc conjugate (ISIS 656173).

TABLE 77

Modified oligonucleotides targeting Factor XI

| ISIS No. | Sequence (5' to 3') | GalNAc cluster | CM | SEQ ID No. |
|---|---|---|---|---|
| 404071 | T$_{es}$G$_{es}$G$_{es}$T$_{es}$A$_{es}$A$_{ds}$T$_{ds}$$^m$C$_{ds}$$^m$C$_{ds}$A$_{ds}$$^m$C$_{ds}$T$_{ds}$T$_{ds}$T$_{ds}$$^m$C$_{ds}$A$_{es}$G$_{es}$A$_{es}$G$_{es}$G$_e$ | n/a | n/a | 2307 |
| 656173 | T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$T$_{ds}$T$_{ds}$T$_{ds}$$^m$C$_{ds}$A$_{eo}$G$_{eo}$A$_{es}$G$_{es}$G$_{eo}$A$_{do}$,-GalNAc$_3$-1$_a$ | GalNAc$_3$-1$_a$ | A$_d$ | 2308 |
| 663086 | GalNAc$_3$-3$_a$-$_o$,A$_{do}$T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$T$_{ds}$ T$_{ds}$T$_{ds}$$^m$C$_{ds}$A$_{eo}$G$_{eo}$A$_{es}$G$_{es}$G$_e$ | GalNAc$_3$-3$_a$ | A$_d$ | 2316 |
| 678347 | GalNAc$_3$-7$_a$-$_o$,A$_{do}$T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$T$_{ds}$ T$_{ds}$T$_{ds}$$^m$C$_{ds}$A$_{eo}$G$_{eo}$A$_{es}$G$_{es}$G$_e$ | GalNAc$_3$-7$_a$ | A$_d$ | 2316 |
| 678348 | GalNAc$_3$-10$_a$-$_o$,A$_{do}$T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$ T$_{ds}$T$_{ds}$T$_{ds}$$^m$C$_{ds}$A$_{eo}$G$_{eo}$A$_{es}$G$_{es}$G$_e$ | GalNAc$_3$-10$_a$ | A$_d$ | 2316 |
| 678349 | GalNAc$_3$-13$_a$-$_o$,A$_{do}$T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$ T$_{ds}$T$_{ds}$T$_{ds}$$^m$C$_{ds}$A$_{eo}$G$_{eo}$A$_{es}$G$_{es}$G$_e$ | GalNAc$_3$-13$_a$ | A$_d$ | 2316 |

TABLE 78

Factor XI liver mRNA, liver transaminase, BUN, and bilirubin levels

| ISIS No. | Dosage (mg/kg) | Factor XI mRNA (% PBS) | ALT (U/L) | AST (U/L) | BUN (mg/dL) | Bilirubin (mg/dL) | GalNAc$_3$ Cluster | SEQ ID No. |
|---|---|---|---|---|---|---|---|---|
| PBS | n/a | 100 | 63 | 70 | 21 | 0.18 | n/a | n/a |
| 404071 | 3 | 65 | 41 | 58 | 21 | 0.15 | n/a | 2307 |
|  | 10 | 33 | 49 | 53 | 23 | 0.15 |  |  |
|  | 30 | 17 | 43 | 57 | 22 | 0.14 |  |  |
| 656173 | 0.7 | 43 | 90 | 89 | 21 | 0.16 | GalNAc$_3$-1a | 2308 |
|  | 2 | 9 | 36 | 58 | 26 | 0.17 |  |  |
|  | 6 | 3 | 50 | 63 | 25 | 0.15 |  |  |
| 663086 | 0.7 | 33 | 91 | 169 | 25 | 0.16 | GalNAc$_3$-3a | 2316 |
|  | 2 | 7 | 38 | 55 | 21 | 0.16 |  |  |
|  | 6 | 1 | 34 | 40 | 23 | 0.14 |  |  |
| 678347 | 0.7 | 35 | 28 | 49 | 20 | 0.14 | GalNAc$_3$-7a | 2316 |
|  | 2 | 10 | 180 | 149 | 21 | 0.18 |  |  |
|  | 6 | 1 | 44 | 76 | 19 | 0.15 |  |  |
| 678348 | 0.7 | 39 | 43 | 54 | 21 | 0.16 | GalNAc$_3$-10a | 2316 |
|  | 2 | 5 | 38 | 55 | 22 | 0.17 |  |  |
|  | 6 | 2 | 25 | 38 | 20 | 0.14 |  |  |
| 678349 | 0.7 | 34 | 39 | 46 | 20 | 0.16 | GalNAc$_3$-13a | 2316 |
|  | 2 | 8 | 43 | 63 | 21 | 0.14 |  |  |
|  | 6 | 2 | 28 | 41 | 20 | 0.14 |  |  |

Example 84

Duration of Action In Vivo of Oligonucleotides Targeting Factor XI Comprising a GalNAc$_3$ Conjugate The oligonucleotides listed in Table 77 were tested in a single dose study for duration of action in mice.

Treatment

Six to eight week old mice were each injected subcutaneously once with an oligonucleotide listed in Table 77 or with PBS. Each treatment group consisted of 4 animals. Blood was drawn by tail bleeds the day before dosing to determine baseline and at 3, 10, and 17 days following the dose. Plasma Factor XI protein levels were measured by ELISA using Factor XI capture and biotinylated detection antibodies from R & D Systems, Minneapolis, Minn. (catalog # AF2460 and # BAF2460, respectively) and the OptEIA Reagent Set B (Catalog #550534, BD Biosciences, San Jose, Calif.). The results below are presented as the average percent of plasma Factor XI protein levels for each treatment group, normalized to baseline levels. The results show that the oligonucleotides comprising a GalNAc conjugate were more potent with longer duration of action than the parent lacking a GalNAc conjugate (ISIS 404071). Furthermore, the oligonucleotides comprising a 5'-GalNAc conjugate (ISIS 663086, 678347, 678348, and 678349) were even more potent with an even longer duration of action than the oligonucleotide comprising a 3'-GalNAc conjugate (ISIS 656173).

TABLE 79

Plasma Factor XI protein levels in mice

| ISIS No. | Dosage (mg/kg) | Time point (days post-dose) | Factor XI (% baseline) | GalNAc$_3$ Cluster | CM | SEQ ID No. |
|---|---|---|---|---|---|---|
| PBS | n/a | 3 | 123 | n/a | n/a | n/a |
|  |  | 10 | 56 |  |  |  |
|  |  | 17 | 100 |  |  |  |

TABLE 79-continued

Plasma Factor XI protein levels in mice

| ISIS No. | Dosage (mg/kg) | Time point (days post-dose) | Factor XI (% baseline) | GalNAc$_3$ Cluster | CM | SEQ ID No. |
|---|---|---|---|---|---|---|
| 404071 | 30 | 3 | 11 | n/a | n/a | 2307 |
|  |  | 10 | 47 |  |  |  |
|  |  | 17 | 52 |  |  |  |
| 656173 | 6 | 3 | 1 | GalNAc$_3$-1a | A$_d$ | 2308 |
|  |  | 10 | 3 |  |  |  |
|  |  | 17 | 21 |  |  |  |
| 663086 | 6 | 3 | 1 | GalNAc$_3$-3a | A$_d$ | 2316 |
|  |  | 10 | 2 |  |  |  |
|  |  | 17 | 9 |  |  |  |
| 678347 | 6 | 3 | 1 | GalNAc$_3$-7a | A$_d$ | 2316 |
|  |  | 10 | 1 |  |  |  |
|  |  | 17 | 8 |  |  |  |
| 678348 | 6 | 3 | 1 | GalNAc$_3$-10a | A$_d$ | 2316 |
|  |  | 10 | 1 |  |  |  |
|  |  | 17 | 6 |  |  |  |
| 678349 | 6 | 3 | 1 | GalNAc$_3$-13a | A$_d$ | 2316 |
|  |  | 10 | 1 |  |  |  |
|  |  | 17 | 5 |  |  |  |

Example 85

Antisense Inhibition In Vivo by Oligonucleotides Targeting SRB-1 Comprising a GalNAc$_3$ Conjugate Oligonucleotides listed in Table 76 were tested in a dose-dependent study for antisense inhibition of SRB-1 in mice.

Treatment

Six to eight week old C57BL/6 mice were each injected subcutaneously once per week at a dosage shown below, for a total of three doses, with an oligonucleotide listed in Table 76 or with saline. Each treatment group consisted of 4 animals. The mice were sacrificed 48 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of liver SRB-1 mRNA levels for each treatment group, normalized to the saline control.

As illustrated in Tables 80 and 81, treatment with antisense oligonucleotides lowered SRB-1 mRNA levels in a dose-dependent manner.

TABLE 80

SRB-1 mRNA in liver

| ISIS No. | Dosage (mg/kg) | SRB-1 mRNA (% Saline) | GalNAc$_3$ Cluster | CM |
|---|---|---|---|---|
| Saline | n/a | 100 | n/a | n/a |
| 655861 | 0.1 | 94 | GalNAc$_3$-1a | A$_d$ |
|  | 0.3 | 119 |  |  |
|  | 1 | 68 |  |  |
|  | 3 | 32 |  |  |
| 661161 | 0.1 | 120 | GalNAc$_3$-3a | A$_d$ |
|  | 0.3 | 107 |  |  |
|  | 1 | 68 |  |  |
|  | 3 | 26 |  |  |
| 666881 | 0.1 | 107 | GalNAc$_3$-10a | A$_d$ |
|  | 0.3 | 107 |  |  |
|  | 1 | 69 |  |  |
|  | 3 | 27 |  |  |
| 666981 | 0.1 | 120 | GalNAc$_3$-7a | A$_d$ |
|  | 0.3 | 103 |  |  |
|  | 1 | 54 |  |  |
|  | 3 | 21 |  |  |
| 670061 | 0.1 | 118 | GalNAc$_3$-13a | A$_d$ |
|  | 0.3 | 89 |  |  |
|  | 1 | 52 |  |  |
|  | 3 | 18 |  |  |
| 677842 | 0.1 | 119 | GalNAc$_3$-20a | A$_d$ |
|  | 0.3 | 96 |  |  |
|  | 1 | 65 |  |  |
|  | 3 | 23 |  |  |

TABLE 81

SRB-1 mRNA in liver

| ISIS No. | Dosage (mg/kg) | SRB-1 mRNA (% Saline) | GalNAc$_3$ Cluster | CM |
|---|---|---|---|---|
| 661161 | 0.1 | 107 | GalNAc$_3$-3a | A$_d$ |
|  | 0.3 | 95 |  |  |
|  | 1 | 53 |  |  |
|  | 3 | 18 |  |  |
| 677841 | 0.1 | 110 | GalNAc$_3$-19a | A$_d$ |
|  | 0.3 | 88 |  |  |
|  | 1 | 52 |  |  |
|  | 3 | 25 |  |  |

Liver transaminase levels, total bilirubin, BUN, and body weights were also measured using standard protocols. Average values for each treatment group are shown in Table 82 below.

TABLE 82

| ISIS No. | Dosage (mg/kg) | ALT (U/L) | AST (U/L) | Bilirubin (mg/dL) | BUN (mg/dL) | Body Weight (% baseline) | GalNAc$_3$ Cluster | CM |
|---|---|---|---|---|---|---|---|---|
| Saline | n/a | 19 | 39 | 0.17 | 26 | 118 | n/a | n/a |
| 655861 | 0.1 | 25 | 47 | 0.17 | 27 | 114 | GalNAc$_3$-1a | A$_d$ |
|  | 0.3 | 29 | 56 | 0.15 | 27 | 118 |  |  |
|  | 1 | 20 | 32 | 0.14 | 24 | 112 |  |  |
|  | 3 | 27 | 54 | 0.14 | 24 | 115 |  |  |
| 661161 | 0.1 | 35 | 83 | 0.13 | 24 | 113 | GalNAc$_3$-3a | A$_d$ |
|  | 0.3 | 42 | 61 | 0.15 | 23 | 117 |  |  |
|  | 1 | 34 | 60 | 0.18 | 22 | 116 |  |  |
|  | 3 | 29 | 52 | 0.13 | 25 | 117 |  |  |
| 666881 | 0.1 | 30 | 51 | 0.15 | 23 | 118 | GalNAc$_3$-10a | A$_d$ |
|  | 0.3 | 49 | 82 | 0.16 | 25 | 119 |  |  |
|  | 1 | 23 | 45 | 0.14 | 24 | 117 |  |  |
|  | 3 | 20 | 38 | 0.15 | 21 | 112 |  |  |
| 666981 | 0.1 | 21 | 41 | 0.14 | 22 | 113 | GalNAc$_3$-7a | A$_d$ |
|  | 0.3 | 29 | 49 | 0.16 | 24 | 112 |  |  |
|  | 1 | 19 | 34 | 0.15 | 22 | 111 |  |  |
|  | 3 | 77 | 78 | 0.18 | 25 | 115 |  |  |
| 670061 | 0.1 | 20 | 63 | 0.18 | 24 | 111 | GalNAc$_3$-13a | A$_d$ |
|  | 0.3 | 20 | 57 | 0.15 | 21 | 115 |  |  |
|  | 1 | 20 | 35 | 0.14 | 20 | 115 |  |  |
|  | 3 | 27 | 42 | 0.12 | 20 | 116 |  |  |
| 677842 | 0.1 | 20 | 38 | 0.17 | 24 | 114 | GalNAc$_3$-20a | A$_d$ |
|  | 0.3 | 31 | 46 | 0.17 | 21 | 117 |  |  |
|  | 1 | 22 | 34 | 0.15 | 21 | 119 |  |  |
|  | 3 | 41 | 57 | 0.14 | 23 | 118 |  |  |

Example 86

Antisense Inhibition In Vivo by Oligonucleotides Targeting TTR Comprising a GalNAc₃ Conjugate Oligonucleotides listed in Table 83 below were tested in a dose-dependent study for antisense inhibition of human transthyretin (TTR) in transgenic mice that express the human TTR gene.

Treatment

Eight week old TTR transgenic mice were each injected subcutaneously once per week for three weeks, for a total of three doses, with an oligonucleotide and dosage listed in the tables below or with PBS. Each treatment group consisted of 4 animals. The mice were sacrificed 72 hours following the final administration. Tail bleeds were performed at various time points throughout the experiment, and plasma TTR protein, ALT, and AST levels were measured and reported in Tables 84-87. After the animals were sacrificed, plasma ALT, AST, and human TTR levels were measured, as were body weights, organ weights, and liver human TTR mRNA levels. TTR protein levels were measured using a clinical analyzer (AU480, Beckman Coulter, Calif.). Real-time PCR and RIBOGREEN® RNA quantification reagent (Molecular Probes, Inc. Eugene, Oreg.) were used according to standard protocols to determine liver human TTR mRNA levels. The results presented in Tables 84-87 are the average values for each treatment group. The mRNA levels are the average values relative to the average for the PBS group. Plasma protein levels are the average values relative to the average value for the PBS group at baseline. Body weights are the average percent weight change from baseline until sacrifice for each individual treatment group. Organ weights shown are normalized to the animal's body weight, and the average normalized organ weight for each treatment group is then presented relative to the average normalized organ weight for the PBS group.

In Tables 84-87, "BL" indicates baseline, measurements that were taken just prior to the first dose. As illustrated in Tables 84 and 85, treatment with antisense oligonucleotides lowered TTR expression levels in a dose-dependent manner. The oligonucleotides comprising a GalNAc conjugate were more potent than the parent lacking a GalNAc conjugate (ISIS 420915). Furthermore, the oligonucleotides comprising a GalNAc conjugate and mixed PS/PO internucleoside linkages were even more potent than the oligonucleotide comprising a GalNAc conjugate and full PS linkages.

TABLE 83

Oligonucleotides targeting human TTR

| Isis No. | Sequence 5' to 3' | Linkages | GalNAc cluster | CM | SEQ ID No. |
|---|---|---|---|---|---|
| 420915 | $T_{es}{}^mC_{es}T_{es}T_{es}G_{es}G_{ds}T_{ds}T_{ds}A_{ds}{}^mC_{ds}A_{ds}T_{ds}G_{ds}A_{ds}A_{ds}A_{es}T_{es}{}^mC_{es}{}^mC_{es}{}^mC_{e}$ | PS | n/a | n/a | 2317 |
| 660261 | $T_{es}{}^mC_{es}T_{es}T_{es}G_{es}G_{ds}T_{ds}T_{ds}A_{ds}{}^mC_{ds}A_{ds}T_{ds}G_{ds}A_{ds}A_{ds}A_{es}T_{es}{}^mC_{es}{}^mC_{es}{}^mC_{eo}A_{do}$,-GalNAc₃-1$_a$ | PS | GalNAc₃-1a | $A_d$ | 2318 |
| 682883 | GalNAc₃-3$_{a-o}$,$T_{es}{}^mC_{eo}T_{eo}T_{eo}G_{eo}G_{ds}T_{ds}T_{ds}A_{ds}{}^mC_{ds}A_{ds}T_{ds}G_{ds}A_{ds}A_{ds}A_{eo}T_{eo}{}^mC_{es}{}^mC_{es}{}^mC_{e}$ | PS/PO | GalNAc₃-3a | PO | 2317 |
| 682884 | GalNAc₃-7$_{a-o}$,$T_{es}{}^mC_{eo}T_{eo}T_{eo}G_{eo}G_{ds}T_{ds}T_{ds}A_{ds}{}^mC_{ds}A_{ds}T_{ds}G_{ds}A_{ds}A_{ds}A_{eo}T_{eo}{}^mC_{es}{}^mC_{es}{}^mC_{e}$ | PS/PO | GalNAc₃-7a | PO | 2317 |
| 682885 | GalNAc₃-10$_{a-o}$,$T_{es}{}^mC_{eo}T_{eo}T_{eo}G_{eo}G_{ds}T_{ds}T_{ds}A_{ds}{}^mC_{ds}A_{ds}T_{ds}G_{ds}A_{ds}A_{ds}A_{eo}T_{eo}{}^mC_{es}{}^mC_{es}{}^mC_{e}$ | PS/PO | GalNAc₃-10a | PO | 2317 |
| 682886 | GalNAc₃-13$_{a-o}$,$T_{es}{}^mC_{eo}T_{eo}T_{eo}G_{eo}G_{ds}T_{ds}T_{ds}A_{ds}{}^mC_{ds}A_{ds}T_{ds}G_{ds}A_{ds}A_{ds}A_{eo}T_{eo}{}^mC_{es}{}^mC_{es}{}^mC_{e}$ | PS/PO | GalNAc₃-13a | PO | 2317 |
| 684057 | $T_{es}{}^mC_{eo}T_{eo}T_{eo}G_{eo}G_{ds}T_{ds}T_{ds}A_{ds}{}^mC_{ds}A_{ds}T_{ds}G_{ds}A_{ds}A_{ds}A_{eo}T_{eo}{}^mC_{es}{}^mC_{es}{}^mC_{eo}A_{do}$,-GalNAc₃-19$_a$ | PS/PO | GalNAc₃-19a | $A_d$ | 2318 |

The legend for Table 85 can be found in Example 74. The structure of GalNAc₃-1 was shown in Example 9. The structure of GalNAc₃-3$_a$ was shown in Example 39. The structure of GalNAc₃-7$_a$ was shown in Example 48. The structure of GalNAc₃-10$_a$ was shown in Example 46. The structure of GalNAc₃-13$_a$ was shown in Example 62. The structure of GalNAc₃-19$_a$ was shown in Example 70.

TABLE 84

Antisense inhibition of human TTR in vivo

| Isis No. | Dosage (mg/kg) | TTR mRNA (% PBS) | Plasma TTR protein (% PBS) | GalNAc cluster | CM | SEQ ID No. |
|---|---|---|---|---|---|---|
| PBS | n/a | 100 | 100 | n/a | n/a | |
| 420915 | 6 | 99 | 95 | n/a | n/a | 2317 |
| | 20 | 48 | 65 | | | |
| | 60 | 18 | 28 | | | |
| 660261 | 0.6 | 113 | 87 | GalNAc₃-1a | $A_d$ | 2318 |
| | 2 | 40 | 56 | | | |
| | 6 | 20 | 27 | | | |
| | 20 | 9 | 11 | | | |

TABLE 85

Antisense inhibition of human TTR in vivo

| Isis No. | Dosage (mg/kg) | TTR mRNA (% PBS) | Plasma TTR protein (% PBS at BL) | | | | GalNAc cluster | CM | SEQ ID No. |
|---|---|---|---|---|---|---|---|---|---|
| | | | BL | Day 3 | Day 10 | Day 17 (After sac) | | | |
| PBS | n/a | 100 | 100 | 96 | 90 | 114 | n/a | n/a | |
| 420915 | 6 | 74 | 106 | 86 | 76 | 83 | n/a | n/a | 2317 |
| | 20 | 43 | 102 | 66 | 61 | 58 | | | |
| | 60 | 24 | 92 | 43 | 29 | 32 | | | |
| 682883 | 0.6 | 60 | 88 | 73 | 63 | 68 | GalNAc$_3$-3a | PO | 2317 |
| | 2 | 18 | 75 | 38 | 23 | 23 | | | |
| | 6 | 10 | 80 | 35 | 11 | 9 | | | |
| 682884 | 0.6 | 56 | 88 | 78 | 63 | 67 | GalNAc$_3$-7a | PO | 2317 |
| | 2 | 19 | 76 | 44 | 25 | 23 | | | |
| | 6 | 15 | 82 | 35 | 21 | 24 | | | |
| 682885 | 0.6 | 60 | 92 | 77 | 68 | 76 | GalNAc$_3$-10a | PO | 2317 |
| | 2 | 22 | 93 | 58 | 32 | 32 | | | |
| | 6 | 17 | 85 | 37 | 25 | 20 | | | |
| 682886 | 0.6 | 57 | 91 | 70 | 64 | 69 | GalNAc$_3$-13a | PO | 2317 |
| | 2 | 21 | 89 | 50 | 31 | 30 | | | |
| | 6 | 18 | 102 | 41 | 24 | 27 | | | |
| 684057 | 0.6 | 53 | 80 | 69 | 56 | 62 | GalNAc$_3$-19a | A$_d$ | 2318 |
| | 2 | 21 | 92 | 55 | 34 | 30 | | | |
| | 6 | 11 | 82 | 50 | 18 | 13 | | | |

TABLE 86

Transaminase levels, body weight changes, and relative organ weights

| Isis No. | Dosage (mg/kg) | ALT (U/L) | | | | AST (U/L) | | | | Body (% BL) | Liver (% PBS) | Spleen (% PBS) | Kidney (% PBS) | SEQ ID No. |
|---|---|---|---|---|---|---|---|---|---|---|---|---|---|---|
| | | BL | Day 3 | Day 10 | Day 17 | BL | Day 3 | Day 10 | Day 17 | | | | | |
| PBS | n/a | 33 | 34 | 33 | 24 | 58 | 62 | 67 | 52 | 105 | 100 | 100 | 100 | n/a |
| 420915 | 6 | 34 | 33 | 27 | 21 | 64 | 59 | 73 | 47 | 115 | 99 | 89 | 91 | 2317 |
| | 20 | 34 | 30 | 28 | 19 | 64 | 54 | 56 | 42 | 111 | 97 | 83 | 89 | |
| | 60 | 34 | 35 | 31 | 24 | 61 | 58 | 71 | 58 | 113 | 102 | 98 | 95 | |
| 660261 | 0.6 | 33 | 38 | 28 | 26 | 70 | 71 | 63 | 59 | 111 | 96 | 99 | 92 | 2318 |
| | 2 | 29 | 32 | 31 | 34 | 61 | 60 | 68 | 61 | 118 | 100 | 92 | 90 | |
| | 6 | 29 | 29 | 28 | 34 | 58 | 59 | 70 | 90 | 114 | 99 | 97 | 95 | |
| | 20 | 33 | 32 | 28 | 33 | 64 | 54 | 68 | 95 | 114 | 101 | 106 | 92 | |

TABLE 87

Transaminase levels, body weight changes, and relative organ weights

| Isis No. | Dosage (mg/kg) | ALT (U/L) | | | | AST (U/L) | | | | Body (% BL) | Liver (% PBS) | Spleen (% PBS) | Kidney (% PBS) | SEQ ID No. |
|---|---|---|---|---|---|---|---|---|---|---|---|---|---|---|
| | | BL | Day 3 | Day 10 | Day 17 | BL | Day 3 | Day 10 | Day 17 | | | | | |
| PBS | n/a | 32 | 34 | 37 | 41 | 62 | 78 | 76 | 77 | 104 | 100 | 100 | 100 | n/a |
| 420915 | 6 | 32 | 30 | 34 | 34 | 61 | 71 | 72 | 66 | 102 | 103 | 102 | 105 | 2317 |
| | 20 | 41 | 34 | 37 | 33 | 80 | 76 | 63 | 54 | 106 | 107 | 135 | 101 | |
| | 60 | 36 | 30 | 32 | 34 | 58 | 81 | 57 | 60 | 106 | 105 | 104 | 99 | |
| 682883 | 0.6 | 32 | 35 | 38 | 40 | 53 | 81 | 74 | 76 | 104 | 101 | 112 | 95 | 2317 |
| | 2 | 38 | 39 | 42 | 43 | 71 | 84 | 70 | 77 | 107 | 98 | 116 | 99 | |
| | 6 | 35 | 35 | 41 | 38 | 62 | 79 | 103 | 65 | 105 | 103 | 143 | 97 | |
| 682884 | 0.6 | 33 | 32 | 35 | 34 | 70 | 74 | 75 | 67 | 101 | 100 | 130 | 99 | 2317 |
| | 2 | 31 | 32 | 38 | 38 | 63 | 77 | 66 | 55 | 104 | 103 | 122 | 100 | |
| | 6 | 38 | 32 | 36 | 34 | 65 | 85 | 80 | 62 | 99 | 105 | 129 | 95 | |
| 682885 | 0.6 | 39 | 26 | 37 | 35 | 63 | 63 | 77 | 59 | 100 | 109 | 109 | 112 | 2317 |
| | 2 | 30 | 26 | 38 | 40 | 54 | 56 | 71 | 72 | 102 | 98 | 111 | 102 | |
| | 6 | 27 | 27 | 34 | 35 | 46 | 52 | 56 | 64 | 102 | 98 | 113 | 96 | |
| 682886 | 0.6 | 30 | 40 | 34 | 36 | 58 | 87 | 54 | 61 | 104 | 99 | 120 | 101 | 2317 |
| | 2 | 27 | 26 | 34 | 36 | 51 | 55 | 55 | 69 | 103 | 91 | 105 | 92 | |
| | 6 | 40 | 28 | 34 | 37 | 107 | 54 | 61 | 69 | 109 | 100 | 102 | 99 | |

TABLE 87-continued

Transaminase levels, body weight changes, and relative organ weights

| Isis No. | Dosage (mg/kg) | ALT (U/L) | | | | AST (U/L) | | | | Body (% BL) | Liver (% PBS) | Spleen (% PBS) | Kidney (% PBS) | SEQ ID No. |
|---|---|---|---|---|---|---|---|---|---|---|---|---|---|---|
| | | BL | Day 3 | Day 10 | Day 17 | BL | Day 3 | Day 10 | Day 17 | | | | | |
| 684057 | 0.6 | 35 | 26 | 33 | 39 | 56 | 51 | 51 | 69 | 104 | 99 | 110 | 102 | 2318 |
| | 2 | 33 | 32 | 31 | 40 | 54 | 57 | 56 | 87 | 103 | 100 | 112 | 97 | |
| | 6 | 39 | 33 | 35 | 40 | 67 | 52 | 55 | 92 | 98 | 104 | 121 | 108 | |

Example 87

Duration of Action In Vivo by Single Doses of Oligonucleotides Targeting TTR Comprising a GalNAc$_3$ Conjugate ISIS numbers 420915 and 660261 (see Table 83) were tested in a single dose study for duration of action in mice. ISIS numbers 420915, 682883, and 682885 (see Table 83) were also tested in a single dose study for duration of action in mice.

Treatment

Eight week old, male transgenic mice that express human TTR were each injected subcutaneously once with 100 mg/kg ISIS No. 420915 or 13.5 mg/kg ISIS No. 660261. Each treatment group consisted of 4 animals. Tail bleeds were performed before dosing to determine baseline and at days 3, 7, 10, 17, 24, and 39 following the dose. Plasma TTR protein levels were measured as described in Example 86. The results below are presented as the average percent of plasma TTR levels for each treatment group, normalized to baseline levels.

TABLE 88

Plasma TTR protein levels

| ISIS No. | Dosage (mg/kg) | Time point (days post-dose) | TTR (% baseline) | GalNAc$_3$ Cluster | CM | SEQ ID No. |
|---|---|---|---|---|---|---|
| 420915 | 100 | 3 | 30 | n/a | n/a | 2317 |
| | | 7 | 23 | | | |
| | | 10 | 35 | | | |
| | | 17 | 53 | | | |
| | | 24 | 75 | | | |
| | | 39 | 100 | | | |
| 660261 | 13.5 | 3 | 27 | GalNAc$_3$-1a | A$_d$ | 2318 |
| | | 7 | 21 | | | |
| | | 10 | 22 | | | |
| | | 17 | 36 | | | |
| | | 24 | 48 | | | |
| | | 39 | 69 | | | |

Treatment

Female transgenic mice that express human TTR were each injected subcutaneously once with 100 mg/kg ISIS No. 420915, 10.0 mg/kg ISIS No. 682883, or 10.0 mg/kg 682885. Each treatment group consisted of 4 animals. Tail bleeds were performed before dosing to determine baseline and at days 3, 7, 10, 17, 24, and 39 following the dose. Plasma TTR protein levels were measured as described in Example 86. The results below are presented as the average percent of plasma TTR levels for each treatment group, normalized to baseline levels.

TABLE 89

Plasma TTR protein levels

| ISIS No. | Dosage (mg/kg) | Time point (days post-dose) | TTR (% baseline) | GalNAc$_3$ Cluster | CM | SEQ ID No. |
|---|---|---|---|---|---|---|
| 420915 | 100 | 3 | 48 | n/a | n/a | 2317 |
| | | 7 | 48 | | | |
| | | 10 | 48 | | | |
| | | 17 | 66 | | | |
| | | 31 | 80 | | | |
| 682883 | 10.0 | 3 | 45 | GalNAc$_3$-3a | PO | 2317 |
| | | 7 | 37 | | | |
| | | 10 | 38 | | | |
| | | 17 | 42 | | | |
| | | 31 | 65 | | | |
| 682885 | 10.0 | 3 | 40 | GalNAc$_3$-10a | PO | 2317 |
| | | 7 | 33 | | | |
| | | 10 | 34 | | | |
| | | 17 | 40 | | | |
| | | 31 | 64 | | | |

The results in Tables 88 and 89 show that the oligonucleotides comprising a GalNAc conjugate are more potent with a longer duration of action than the parent oligonucleotide lacking a conjugate (ISIS 420915).

Example 88

Splicing Modulation In Vivo by Oligonucleotides Targeting SMN Comprising a GalNAc$_3$ Conjugate The oligonucleotides listed in Table 90 were tested for splicing modulation of human survival of motor neuron (SMN) in mice.

TABLE 90

Modified ASOs targeting SMN

| ISIS No. | Sequences (5' to 3') | GalNAc$_3$ Cluster | CM | SEQ ID No. |
|---|---|---|---|---|
| 387954 | A$_{es}$T$_{es}$T$_{es}$$^m$C$_{es}$A$_{es}$$^m$C$_{es}$T$_{es}$T$_{es}$T$_{es}$$^m$C$_{es}$A$_{es}$T$_{es}$A$_{es}$A$_{es}$T$_{es}$G$_{es}$$^m$C$_{es}$T$_{es}$G$_{es}$G$_{e}$ | n/a | n/a | 2319 |

TABLE 90-continued

Modified ASOs targeting SMN

| ISIS No. | Sequences (5' to 3') | GalNAc$_3$ Cluster | CM | SEQ ID No. |
|---|---|---|---|---|
| 699819 | GalNAc$_3$-7$_a$-$_o$,A$_{es}$T$_{es}$T$_{es}$$^m$C$_{es}$A$_{es}$$^m$C$_{es}$T$_{es}$T$_{es}$T$_{es}$$^m$C$_{es}$A$_{es}$T$_{es}$A$_{es}$A$_{es}$T$_{es}$G$_{es}$$^m$C$_{es}$T$_{es}$G$_{es}$G$_e$ | GalNAc$_3$-7a | PO | 2319 |
| 699821 | GalNAc$_3$-7$_a$-$_o$,A$_{es}$T$_{eo}$T$_{eo}$$^m$C$_{eo}$A$_{eo}$$^m$C$_{eo}$T$_{eo}$T$_{eo}$T$_{eo}$$^m$C$_{eo}$A$_{eo}$T$_{eo}$A$_{eo}$A$_{eo}$T$_{eo}$G$_{eo}$$^m$C$_{eo}$T$_{es}$G$_{es}$G$_e$ | GalNAc$_3$-7a | PO | 2319 |
| 700000 | A$_{es}$T$_{es}$T$_{es}$$^m$C$_{es}$A$_{es}$$^m$C$_{es}$T$_{es}$T$_{es}$T$_{es}$$^m$C$_{es}$A$_{es}$T$_{es}$A$_{es}$A$_{es}$T$_{es}$G$_{es}$$^m$C$_{es}$T$_{es}$G$_{es}$G$_{eo}$A$_{do}$,-GalNAc$_3$-1$_a$ | GalNAc$_3$-1a | A$_d$ | 2320 |
| 703421 | X-ATT$^m$CA$^m$CTTT$^m$CATAATG$^m$CTGG | n/a | n/a | 2319 |
| 703422 | GalNAc$_3$-7$_b$-X-ATT$^m$CA$^m$CTTT$^m$CATAATG$^m$CTGG | GalNAc$_3$-7b | n/a | 2319 |

The structure of GalNAc$_3$-7$_a$ was shown previously in Example 48. "X" indicates a 5' primary amine generated by Gene Tools (Philomath, Oreg.), and GalNAc$_3$-7$_b$ indicates the structure of GalNAc$_3$-7$_a$ lacking the —NH—C$_6$—O portion of the linker, as shown below:

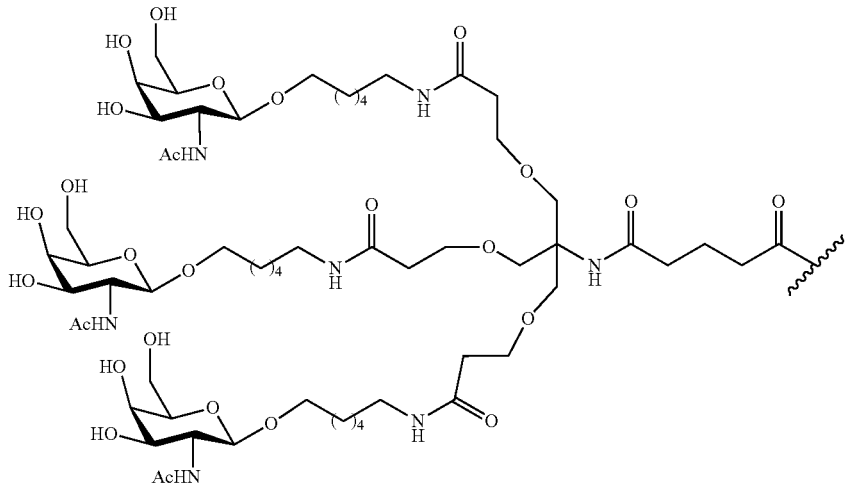

ISIS numbers 703421 and 703422 are morphlino oligonucleotides, wherein each nucleotide of the two oligonucleotides is a morpholino nucleotide.

Treatment

Six week old transgenic mice that express human SMN were injected subcutaneously once with an oligonucleotide listed in Table 91 or with saline. Each treatment group consisted of 2 males and 2 females. The mice were sacrificed 3 days following the dose to determine the liver human SMN mRNA levels both with and without exon 7 using real-time PCR according to standard protocols. Total RNA was measured using Ribogreen reagent. The SMN mRNA levels were normalized to total mRNA, and further normalized to the averages for the saline treatment group. The resulting average ratios of SMN mRNA including exon 7 to SMN mRNA missing exon 7 are shown in Table 91. The results show that fully modified oligonucleotides that modulate splicing and comprise a GalNAc conjugate are significantly more potent in altering splicing in the liver than the parent oligonucleotides lacking a GlaNAc conjugate. Furthermore, this trend is maintained for multiple modification chemistries, including 2'-MOE and morpholino modified oligonucleotides.

TABLE 91

Effect of oligonucleotides targeting human SMN in vivo

| ISIS No. | Dose (mg/kg) | +Exon 7/-Exon 7 | GalNAc$_3$ Cluster | CM | SEQ ID No. |
|---|---|---|---|---|---|
| Saline | n/a | 1.00 | n/a | n/a | n/a |
| 387954 | 32 | 1.65 | n/a | n/a | 2319 |
| 387954 | 288 | 5.00 | n/a | n/a | 2319 |
| 699819 | 32 | 7.84 | GalNAc$_3$-7a | PO | 2319 |
| 699821 | 32 | 7.22 | GalNAc$_3$-7a | PO | 2319 |
| 700000 | 32 | 6.91 | GalNAc$_3$-1a | A$_d$ | 2320 |
| 703421 | 32 | 1.27 | n/a | n/a | 2319 |
| 703422 | 32 | 4.12 | GalNAc$_3$-7b | n/a | 2319 |

Example 89

Antisense Inhibition In Vivo by Oligonucleotides Targeting Apolipoprotein a (Apo(a)) Comprising a GalNAc₃ Conjugate The oligonucleotides listed in Table 92 below were tested in a study for dose-dependent inhibition of Apo(a) in transgenic mice.

TABLE 92

Modified ASOs targeting Apo(a)

| ISIS No. | Sequences (5' to 3') | GalNAc₃ Cluster | CM | SEQ ID No. |
|---|---|---|---|---|
| 494372 | T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$ T$_{ds}$T$_{es}$G$_{es}$T$_{es}$T$_{es}$$^m$C$_{e}$ | n/a | n/a | 2321 |
| 681257 | GalNAc₃-7$_a$-$_o$,T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$ T$_{ds}$G$_{ds}$$^m$C$_{ds}$ T$_{ds}$T$_{eo}$G$_{eo}$T$_{es}$T$_{es}$$^m$C$_{e}$ | GalNAc₃-7a | PO | 2321 |

The structure of GalNAc₃-7$_a$ was shown in Example 48.

Treatment

Eight week old, female C57BL/6 mice (Jackson Laboratory, Bar Harbor, Me.) were each injected subcutaneously once per week at a dosage shown below, for a total of six doses, with an oligonucleotide listed in Table 92 or with PBS. Each treatment group consisted of 3-4 animals. Tail bleeds were performed the day before the first dose and weekly following each dose to determine plasma Apo(a) protein levels. The mice were sacrificed two days following the final administration. Apo(a) liver mRNA levels were determined using real-time PCR and RIBOGREEN® RNA quantification reagent (Molecular Probes, Inc. Eugene, Oreg.) according to standard protocols. Apo(a) plasma protein levels were determined using ELISA, and liver transaminase levels were determined. The mRNA and plasma protein results in Table 93 are presented as the treatment group average percent relative to the PBS treated group. Plasma protein levels were further normalized to the baseline (BL) value for the PBS group. Average absolute transaminase levels and body weights (% relative to baseline averages) are reported in Table 94.

As illustrated in Table 93, treatment with the oligonucleotides lowered Apo(a) liver mRNA and plasma protein levels in a dose-dependent manner. Furthermore, the oligonucleotide comprising the GalNAc conjugate was significantly more potent with a longer duration of action than the parent oligonucleotide lacking a GalNAc conjugate. As illustrated in Table 94, transaminase levels and body weights were unaffected by the oligonucleotides, indicating that the oligonucleotides were well tolerated.

TABLE 94

| ISIS No. | Dosage (mg/kg) | ALT (U/L) | AST (U/L) | Body weight (% baseline) |
|---|---|---|---|---|
| PBS | n/a | 37 | 54 | 103 |
| 494372 | 3 | 28 | 68 | 106 |
|  | 10 | 22 | 55 | 102 |
|  | 30 | 19 | 48 | 103 |
| 681257 | 0.3 | 30 | 80 | 104 |
|  | 1 | 26 | 47 | 105 |
|  | 3 | 29 | 62 | 102 |
|  | 10 | 21 | 52 | 107 |

Example 90

Antisense Inhibition In Vivo by Oligonucleotides Targeting TTR Comprising a GalNAc₃ Conjugate Oligonucleotides listed in Table 95 below were tested in a dose-dependent study for antisense inhibition of human transthyretin (TTR) in transgenic mice that express the human TTR gene.

Treatment

TTR transgenic mice were each injected subcutaneously once per week for three weeks, for a total of three doses, with an oligonucleotide and dosage listed in Table 96 or with PBS. Each treatment group consisted of 4 animals. Prior to the first dose, a tail bleed was performed to determine plasma TTR protein levels at baseline (BL). The mice were sacrificed 72 hours following the final administration. TTR protein levels were measured using a clinical analyzer (AU480, Beckman Coulter, Calif.). Real-time PCR and

TABLE 93

Apo(a) liver mRNA and plasma protein levels

| ISIS No. | Dosage (mg/kg) | Apo(a) mRNA (% PBS) | Apo(a) plasma protein (% PBS) | | | | | | |
|---|---|---|---|---|---|---|---|---|---|
|  |  |  | BL | Week 1 | Week 2 | Week 3 | Week 4 | Week 5 | Week 6 |
| PBS | n/a | 100 | 100 | 120 | 119 | 113 | 88 | 121 | 97 |
| 494372 | 3 | 80 | 84 | 89 | 91 | 98 | 87 | 87 | 79 |
|  | 10 | 30 | 87 | 72 | 76 | 71 | 57 | 59 | 46 |
|  | 30 | 5 | 92 | 54 | 28 | 10 | 7 | 9 | 7 |
| 681257 | 0.3 | 75 | 79 | 76 | 89 | 98 | 71 | 94 | 78 |
|  | 1 | 19 | 79 | 88 | 66 | 60 | 54 | 32 | 24 |
|  | 3 | 2 | 82 | 52 | 17 | 7 | 4 | 6 | 5 |
|  | 10 | 2 | 79 | 17 | 6 | 3 | 2 | 4 | 5 |

RIBOGREEN® RNA quantification reagent (Molecular Probes, Inc. Eugene, Oreg.) were used according to standard protocols to determine liver human TTR mRNA levels. The results presented in Table 96 are the average values for each treatment group. The mRNA levels are the average values relative to the average for the PBS group. Plasma protein levels are the average values relative to the average value for the PBS group at baseline. "BL" indicates baseline, measurements that were taken just prior to the first dose. As illustrated in Table 96, treatment with antisense oligonucleotides lowered TTR expression levels in a dose-dependent manner. The oligonucleotides comprising a GalNAc conjugate were more potent than the parent lacking a GalNAc conjugate (ISIS 420915), and oligonucleotides comprising a phosphodiester or deoxyadenosine cleavable moiety showed significant improvements in potency compared to the parent lacking a conjugate (see ISIS numbers 682883 and 666943 vs 420915 and see Examples 86 and 87).

TABLE 95

Oligonucleotides targeting human TTR

| Isis No. | Sequence 5' to 3' | GalNAc Linkages | cluster | CM | SEQ ID No. |
|---|---|---|---|---|---|
| 420915 | $T_{es}{}^mC_{es}T_{es}T_{es}G_{es}G_{ds}T_{ds}T_{ds}A_{ds}{}^mC_{ds}A_{ds}T_{ds}G_{ds}A_{ds}A_{ds}$ $A_{es}T_{es}{}^mC_{es}{}^mC_{es}{}^mC_e$ | PS | n/a | n/a | 2317 |
| 682883 | GalNAc$_3$-3$_{a-o}$.$T_{es}{}^mC_{eo}T_{eo}T_{eo}G_{eo}G_{ds}T_{ds}T_{ds}A_{ds}{}^mC_{ds}A_{ds}$ $T_{ds}G_{ds}A_{ds}A_{ds}A_{eo}T_{eo}{}^mC_{es}{}^mC_{es}{}^mC_e$ | PS/PO | GalNAc$_3$-3a | PO | 2317 |
| 666943 | GalNAc$_3$-3$_{a-o}$.$A_{do}T_{es}{}^mC_{eo}T_{eo}T_{eo}G_{eo}G_{ds}T_{ds}T_{ds}A_{ds}$ ${}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-3a | A$_d$ | 2322 |
| 682887 | GalNAc$_3$-7$_{a-o}$.$A_{do}T_{es}{}^mC_{eo}T_{eo}T_{eo}G_{eo}G_{ds}T_{ds}T_{ds}A_{ds}$ ${}^mC_{ds}A_{ds}T_{as}G_{ds}A_{ds}A_{ds}A_{eo}T_{eo}{}^mC_{es}{}^mC_{es}{}^mC_e$ | PS/PO | GalNAc$_3$-7a | A$_d$ | 2322 |
| 682888 | GalNAc$_3$-10$_{a-o}$.$A_{do}T_{es}{}^mC_{eo}T_{eo}T_{eo}G_{eo}G_{ds}T_{ds}T_{ds}A_{ds}$ ${}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-10a | A$_d$ | 2322 |
| 682889 | GalNAc$_3$-13$_{a-o}$.$A_{do}T_{es}{}^mC_{eo}T_{eo}T_{eo}G_{eo}G_{ds}T_{ds}T_{ds}A_{ds}$ ${}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-13a | A$_d$ | 2322 |

The legend for Table 95 can be found in Example 74. The structure of GalNAc$_3$-3$_a$ was shown in Example 39. The structure of GalNAc$_3$-7$_a$ was shown in Example 48. The structure of GalNAc$_3$-10$_a$ was shown in Example 46. The structure of GalNAc$_3$-13$_a$ was shown in Example 62.

TABLE 96

Antisense inhibition of human TTR in vivo

| Isis No. | Dosage (mg/kg) | TTR mRNA (% PBS) | TTR protein (% BL) | GalNAc cluster | CM |
|---|---|---|---|---|---|
| PBS | n/a | 100 | 124 | n/a | n/a |
| 420915 | 6 | 69 | 114 | n/a | n/a |
|  | 20 | 71 | 86 |  |  |
|  | 60 | 21 | 36 |  |  |
| 682883 | 0.6 | 61 | 73 | GalNAc$_3$-3a | PO |
|  | 2 | 23 | 36 |  |  |
|  | 6 | 18 | 23 |  |  |
| 666943 | 0.6 | 74 | 93 | GalNAc$_3$-3a | A$_d$ |
|  | 2 | 33 | 57 |  |  |
|  | 6 | 17 | 22 |  |  |
| 682887 | 0.6 | 60 | 97 | GalNAc$_3$-7a | A$_d$ |
|  | 2 | 36 | 49 |  |  |
|  | 6 | 12 | 19 |  |  |
| 682888 | 0.6 | 65 | 92 | GalNAc$_3$-10a | A$_d$ |
|  | 2 | 32 | 46 |  |  |
|  | 6 | 17 | 22 |  |  |
| 682889 | 0.6 | 72 | 74 | GalNAc$_3$-13a | A$_d$ |
|  | 2 | 38 | 45 |  |  |
|  | 6 | 16 | 18 |  |  |

Example 91

Antisense Inhibition In Vivo by Oligonucleotides Targeting Factor VII Comprising a GalNAc$_3$ Conjugate in Non-Human Primates Oligonucleotides listed in Table 97 below were tested in a non-terminal, dose escalation study for antisense inhibition of Factor VII in monkeys.

Treatment

Non-naïve monkeys were each injected subcutaneously on days 0, 15, and 29 with escalating doses of an oligonucleotide listed in Table 97 or with PBS. Each treatment group consisted of 4 males and 1 female. Prior to the first dose and at various time points thereafter, blood draws were performed to determine plasma Factor VII protein levels. Factor VII protein levels were measured by ELISA. The results presented in Table 98 are the average values for each treatment group relative to the average value for the PBS group at baseline (BL), the measurements taken just prior to the first dose. As illustrated in Table 98, treatment with antisense oligonucleotides lowered Factor VII expression levels in a dose-dependent manner, and the oligonucleotide comprising the GalNAc conjugate was significantly more potent in monkeys compared to the oligonucleotide lacking a GalNAc conjugate.

TABLE 97

Oligonucleotides targeting Factor VII

| Isis No. | Sequence 5' to 3' | Linkages | GalNAc cluster | CM | SEQ ID No. |
|---|---|---|---|---|---|
| 407935 | $A_{es}T_{es}G_{es}{}^mC_{es}A_{es}T_{ds}G_{ds}G_{ds}T_{ds}G_{ds}A_{ds}T_{ds}G_{ds}{}^mC_{ds}T_{ds}$ $T_{es}{}^mC_{es}T_{es}G_{es}A_e$ | PS | n/a | n/a | 2323 |
| 686892 | GalNAc$_3$-10$_{a-o}$,$A_{es}T_{es}G_{es}{}^mC_{es}A_{es}T_{ds}G_{ds}G_{ds}T_{ds}G_{ds}$ $A_{ds}T_{ds}G_{ds}{}^mC_{ds}T_{ds}T_{es}{}^mC_{es}T_{es}G_{es}A_e$ | PS | GalNAc$_3$-10a | PO | 2323 |

The legend for Table 97 can be found in Example 74. The structure of GalNAc$_3$-10$_a$ was shown in Example 46.

TABLE 98

Factor VII plasma protein levels

| ISIS No. | Day | Dose (mg/kg) | Factor VII (% BL) |
|---|---|---|---|
| 407935 | 0 | n/a | 100 |
| | 15 | 10 | 87 |
| | 22 | n/a | 92 |
| | 29 | 30 | 77 |
| | 36 | n/a | 46 |
| | 43 | n/a | 43 |
| 686892 | 0 | 3 | 100 |
| | 15 | 10 | 56 |
| | 22 | n/a | 29 |
| | 29 | 30 | 19 |
| | 36 | n/a | 15 |
| | 43 | n/a | 11 |

Example 92

Antisense Inhibition in Primary Hepatocytes by Antisense Oligonucleotides Targeting Apo-CIII Comprising a GalNAc$_3$ Conjugate Primary mouse hepatocytes were seeded in 96-well plates at 15,000 cells per well, and the oligonucleotides listed in Table 99, targeting mouse ApoC-III, were added at 0.46, 1.37, 4.12, or 12.35, 37.04, 111.11, or 333.33 nM or 1.00 µM. After incubation with the oligonucleotides for 24 hours, the cells were lysed and total RNA was purified using RNeasy (Qiagen). ApoC-III mRNA levels were determined using real-time PCR and RIBOGREEN® RNA quantification reagent (Molecular Probes, Inc.) according to standard protocols. IC$_{50}$ values were determined using Prism 4 software (GraphPad). The results show that regardless of whether the cleavable moiety was a phosphodiester or a deoxyadensoine, the oligonucleotides comprising a GalNAc conjugate were significantly more potent than the parent oligonucleotide lacking a conjugate.

TABLE 99

Inhibition of mouse APOC-III expression in mouse primary hepatocytes

| ISIS No. | Sequence (5' to 3') | CM | IC$_{50}$ (nM) | SEQ ID No. |
|---|---|---|---|---|
| 440670 | ${}^mC_{es}A_{es}G_{es}{}^mC_{es}T_{es}T_{ds}T_{ds}A_{ds}T_{ds}T_{ds}A_{ds}G_{ds}G_{ds}G_{ds}A_{ds}{}^mC_{es}A_{es}G_{es}{}^mC_{es}A_e$ | n/a | 13.20 | 2324 |
| 661180 | ${}^mC_{es}A_{es}G_{es}{}^mC_{es}T_{es}T_{ds}T_{ds}A_{ds}T_{ds}T_{ds}A_{ds}G_{ds}G_{ds}G_{ds}A_{ds}{}^mC_{es}$ $A_{es}G_{es}{}^mC_{es}A_{eo}A_{do}$,-GalNAc$_3$-1$_a$ | A$_d$ | 1.40 | 2325 |
| 680771 | GalNAc$_3$-3$_{a-o}$,${}^mC_{es}A_{es}G_{es}{}^mC_{es}T_{es}T_{ds}T_{ds}A_{ds}T_{ds}T_{ds}A_{ds}G_{ds}G_{ds}G_{ds}A_{ds}{}^mC_{es}$ $A_{es}G_{es}{}^mC_{es}A_e$ | PO | 0.70 | 2324 |
| 680772 | GalNAc$_3$-7$_{a-o}$,${}^mC_{es}A_{es}G_{es}{}^mC_{es}T_{es}T_{ds}T_{ds}A_{ds}T_{ds}T_{ds}A_{ds}G_{ds}G_{ds}G_{ds}A_{ds}{}^mC_{es}$ $A_{es}G_{es}{}^mC_{es}A_e$ | PO | 1.70 | 2324 |
| 680773 | GalNAc$_3$-10$_{a-o}$,${}^mC_{es}A_{es}G_{es}{}^mC_{es}T_{es}T_{ds}T_{ds}A_{ds}T_{ds}T_{ds}A_{ds}G_{ds}G_{ds}G_{ds}A_{ds}{}^mC_{es}$ $A_{es}G_{es}{}^mC_{es}A_e$ | PO | 2.00 | 2324 |
| 680774 | GalNAc$_3$-13$_{a-o}$,${}^mC_{es}A_{es}G_{es}{}^mC_{es}T_{es}T_{ds}T_{ds}A_{ds}T_{ds}T_{ds}A_{ds}G_{ds}G_{ds}G_{ds}A_{ds}{}^mC_{es}$ $A_{es}G_{es}{}^mC_{es}A_e$ | PO | 1.50 | 2324 |
| 681272 | GalNAc$_3$-3$_{a-o}$,${}^mC_{es}A_{eo}G_{eo}{}^mC_{eo}T_{eo}T_{ds}T_{ds}A_{ds}T_{ds}T_{ds}A_{ds}G_{ds}G_{ds}G_{ds}A_{ds}{}^mC_{eo}$ $A_{eo}G_{es}{}^mC_{es}A_e$ | PO | <0.46 | 2324 |
| 681273 | GalNAc$_3$-3$_{a-o}$,$A_{do}{}^mC_{es}A_{es}G_{es}{}^mC_{es}T_{es}T_{ds}T_{ds}A_{ds}T_{ds}T_{ds}A_{ds}G_{ds}G_{ds}G_{ds}A_{ds}$ ${}^mC_{es}A_{es}G_{es}{}^mC_{es}A_e$ | A$_d$ | 1.10 | 2324 |
| 683733 | ${}^mC_{es}A_{es}G_{es}{}^mC_{es}T_{es}T_{ds}T_{ds}A_{ds}T_{ds}T_{ds}A_{ds}G_{ds}G_{ds}G_{ds}A_{ds}{}^mC_{es}$ $A_{es}G_{es}{}^mC_{es}A_{eo}A_{do}$,-GalNAc$_3$-19$_a$ | A$_d$ | 2.50 | 2325 |

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, GalNAc$_3$-13$_a$ was shown in Example 62, and GalNAc$_3$-19$_a$ was shown in Example 70.

Example 93

Antisense Inhibition In Vivo by Oligonucleotides Targeting SRB-1 Comprising Mixed Wings and a 5'-GalNAc$_3$ Conjugate The oligonucleotides listed in Table 100 were tested in a dose-dependent study for antisense inhibition of SRB-1 in mice.

TABLE 100

Modified ASOs targeting SRB-1

| ISIS No. | Sequence (5' to 3') | GalNAc$_3$ Cluster | CM | SEQ ID No. |
|---|---|---|---|---|
| 449093 | T$_{ks}$T$_{ks}$$^m$C$_{ks}$A$_{ds}$G$_{ds}$T$_{ds}$$^m$C$_{ds}$ A$_{ds}$T$_{ds}$ G$_{ds}$ A$_{ds}$$^m$C$_{ds}$T$_{ds}$T$_{ks}$$^m$C$_{ks}$$^m$C$_k$ | n/a | n/a | 2326 |
| 699806 | GalNAc$_3$-3$_a$-$_o$,T$_{ks}$T$_{ks}$$^m$C$_{ks}$A$_{ds}$G$_{ds}$T$_{ds}$$^m$C$_{ds}$ A$_{ds}$T$_{ds}$ G$_{ds}$A$_{ds}$$^m$C$_{ds}$ T$_{ds}$T$_{ks}$$^m$C$_{ks}$$^m$C$_k$ | GalNAc$_3$-3a | PO | 2326 |
| 699807 | GalNAc$_3$-7$_a$-$_o$,T$_{ks}$T$_{ks}$$^m$C$_{ks}$A$_{ds}$G$_{ds}$T$_{ds}$$^m$C$_{ds}$ A$_{ds}$T$_{ds}$ G$_{ds}$A$_{ds}$$^m$C$_{ds}$ T$_{ds}$T$_{ks}$$^m$C$_{ks}$$^m$C$_k$ | GalNAc$_3$-7a | PO | 2326 |
| 699809 | GalNAc$_3$-7$_a$-$_o$, T$_{ks}$T$_{ks}$$^m$C$_{ks}$A$_{ds}$G$_{ds}$T$_{ds}$$^m$C$_{ds}$ A$_{ds}$T$_{ds}$ G$_{ds}$ A$_{ds}$$^m$C$_{ds}$ T$_{ds}$T$_{es}$$^m$C$_{es}$$^m$C$_e$ | GalNAc$_3$-7a | PO | 2326 |
| 699811 | GalNAc$_3$-7$_a$-$_o$,T$_{es}$T$_{es}$$^m$C$_{es}$A$_{ds}$G$_{ds}$T$_{ds}$$^m$C$_{ds}$ A$_{ds}$T$_{ds}$ G$_{ds}$A$_{ds}$$^m$C$_{ds}$ T$_{ds}$T$_{ks}$$^m$C$_{ks}$$^m$C$_k$ | GalNAc$_3$-7a | PO | 2326 |
| 699813 | GalNAc$_3$-7$_a$-$_o$,T$_{ks}$T$_{ds}$$^m$C$_{ks}$A$_{ds}$G$_{ds}$T$_{ds}$$^m$C$_{ds}$ A$_{ds}$T$_{ds}$ G$_{ds}$A$_{ds}$$^m$C$_{ds}$ T$_{ds}$T$_{ks}$$^m$C$_{ds}$$^m$C$_k$ | GalNAc$_3$-7a | PO | 2326 |
| 699815 | GalNAc$_3$-7$_a$-$_o$,T$_{es}$T$_{ks}$$^m$C$_{ks}$A$_{ds}$G$_{ds}$T$_{ds}$$^m$C$_{ds}$ A$_{ds}$T$_{ds}$ G$_{ds}$A$_{ds}$$^m$C$_{ds}$ T$_{ds}$T$_{ks}$$^m$C$_{ks}$$^m$C$_e$ | GalNAc$_3$-7a | PO | 2326 |

The structure of GalNAc$_3$-3$_a$ was shown previously in Example 39, and the structure of GalNAc$_3$-7a was shown previously in Example 48. Subscripts: "e" indicates 2'-MOE modified nucleoside; "d" indicates β-D-2'-deoxyribonucleoside; "k" indicates 6'-(S)—CH$_3$ bicyclic nucleoside (cEt); "s" indicates phosphorothioate internucleoside linkages (PS); "o" indicates phosphodiester internucleoside linkages (PO). Superscript "m" indicates 5-methylcytosines.

Treatment

Six to eight week old C57BL/6 mice (Jackson Laboratory, Bar Harbor, Me.) were injected subcutaneously once at the dosage shown below with an oligonucleotide listed in Table 100 or with saline. Each treatment group consisted of 4 animals. The mice were sacrificed 72 hours following the final administration. Liver SRB-1 mRNA levels were measured using real-time PCR. SRB-1 mRNA levels were normalized to cyclophilin mRNA levels according to standard protocols. The results are presented as the average percent of SRB-1 mRNA levels for each treatment group relative to the saline control group. As illustrated in Table 101, treatment with antisense oligonucleotides lowered SRB-1 mRNA levels in a dose-dependent manner, and the gapmer oligonucleotides comprising a GalNAc conjugate and having wings that are either full cEt or mixed sugar modifications were significantly more potent than the parent oligonucleotide lacking a conjugate and comprising full cEt modified wings.

Body weights, liver transaminases, total bilirubin, and BUN were also measured, and the average values for each treatment group are shown in Table 101. Body weight is shown as the average percent body weight relative to the baseline body weight (% BL) measured just prior to the oligonucleotide dose.

TABLE 101

SRB-1 mRNA, ALT, AST, BUN, and total bilirubin levels and body weights

| ISIS No. | Dosage (mg/kg) | SRB-1 mRNA (% PBS) | ALT (U/L) | AST (U/L) | Bil | BUN | Body weight (% BL) |
|---|---|---|---|---|---|---|---|
| PBS | n/a | 100 | 31 | 84 | 0.15 | 28 | 102 |
| 449093 | 1 | 111 | 18 | 48 | 0.17 | 31 | 104 |
|  | 3 | 94 | 20 | 43 | 0.15 | 26 | 103 |
|  | 10 | 36 | 19 | 50 | 0.12 | 29 | 104 |
| 699806 | 0.1 | 114 | 23 | 58 | 0.13 | 26 | 107 |
|  | 0.3 | 59 | 21 | 45 | 0.12 | 27 | 108 |
|  | 1 | 25 | 30 | 61 | 0.12 | 30 | 104 |
| 699807 | 0.1 | 121 | 19 | 41 | 0.14 | 25 | 100 |
|  | 0.3 | 73 | 23 | 56 | 0.13 | 26 | 105 |
|  | 1 | 24 | 22 | 69 | 0.14 | 25 | 102 |
| 699809 | 0.1 | 125 | 23 | 57 | 0.14 | 26 | 104 |
|  | 0.3 | 70 | 20 | 49 | 0.10 | 25 | 105 |
|  | 1 | 33 | 34 | 62 | 0.17 | 25 | 107 |
| 699811 | 0.1 | 123 | 48 | 77 | 0.14 | 24 | 106 |
|  | 0.3 | 94 | 20 | 45 | 0.13 | 25 | 101 |
|  | 1 | 66 | 57 | 104 | 0.14 | 24 | 107 |
| 699813 | 0.1 | 95 | 20 | 58 | 0.13 | 28 | 104 |
|  | 0.3 | 98 | 22 | 61 | 0.17 | 28 | 105 |
|  | 1 | 49 | 19 | 47 | 0.11 | 27 | 106 |
| 699815 | 0.1 | 93 | 30 | 79 | 0.17 | 25 | 105 |
|  | 0.3 | 64 | 30 | 61 | 0.12 | 26 | 105 |
|  | 1 | 24 | 18 | 41 | 0.14 | 25 | 106 |

Example 94

Antisense Inhibition In Vivo by Oligonucleotides Targeting SRB-1 Comprising 2'-Sugar Modifications and a 5'-GalNAc$_3$ Conjugate The oligonucleotides listed in Table 102 were tested in a dose-dependent study for antisense inhibition of SRB-1 in mice.

TABLE 102

Modified ASOs targeting SRB-1

| ISIS No. | Sequence (5' to 3') | GalNAc$_3$ Cluster | CM | SEQ ID No. |
|---|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | n/a | n/a | 2304 |
| 700989 | G$_{ms}$C$_{ms}$U$_{ms}$U$_{ms}$C$_{ms}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$U$_{ms}$C$_{ms}$C$_{ms}$U$_{ms}$U$_m$ | n/a | n/a | 2327 |
| 666904 | GalNAc$_3$-3$_a$-$_o$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3a | PO | 2304 |
| 700991 | GalNAc$_3$-7$_a$-$_o$'G$_{ms}$C$_{ms}$U$_{ms}$U$_{ms}$C$_{ms}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$U$_{ms}$C$_{ms}$C$_{ms}$U$_{ms}$U$_m$ | GalNAc$_3$-7a | PO | 2327 |

Subscript "m" indicates a 2'-O-methyl modified nucleoside. See Example 74 for complete table legend. The structure of GalNAc$_3$-3$_a$ was shown previously in Example 39, and the structure of GalNAc$_3$-7a was shown previously in Example 48.

Treatment

The study was completed using the protocol described in Example 93. Results are shown in Table 103 below and show that both the 2'-MOE and 2'-OMe modified oligonucleotides comprising a GalNAc conjugate were significantly more potent than the respective parent oligonucleotides lacking a conjugate. The results of the body weights, liver transaminases, total bilirubin, and BUN measurements indicated that the compounds were all well tolerated.

TABLE 103

SRB-1 mRNA

| ISIS No. | Dosage (mg/kg) | SRB-1 mRNA (% PBS) |
|---|---|---|
| PBS | n/a | 100 |
| 353382 | 5 | 116 |
|  | 15 | 58 |
|  | 45 | 27 |
| 700989 | 5 | 120 |
|  | 15 | 92 |
|  | 45 | 46 |
| 666904 | 1 | 98 |
|  | 3 | 45 |
|  | 10 | 17 |
| 700991 | 1 | 118 |
|  | 3 | 63 |
|  | 10 | 14 |

Example 95

Antisense Inhibition In Vivo by Oligonucleotides Targeting SRB-1 Comprising Bicyclic Nucleosides and a 5'-GalNAc$_3$ Conjugate The oligonucleotides listed in Table 104 were tested in a dose-dependent study for antisense inhibition of SRB-1 in mice.

TABLE 104

Modified ASOs targeting SRB-1

| ISIS No. | Sequences (5' to 3') | GalNAc$_3$ Cluster | CM | SEQ ID No |
|---|---|---|---|---|
| 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | n/a | n/a | 2298 |
| 666905 | GalNAc$_3$-3$_a$-$_o$'T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_3$-3$_a$ | PO | 2298 |
| 699782 | GalNAc$_3$-7$_a$-$_o$'T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_3$-7$_a$ | PO | 2298 |
| 699783 | GalNAc$_3$-3$_a$-$_o$'T$_{ls}$$^m$C$_{ls}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ls}$$^m$C$_l$ | GalNAc$_3$-3$_a$ | PO | 2298 |
| 653621 | T$_{ls}$$^m$C$_{ls}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ls}$$^m$C$_l$A$_{do}$'-GalNAc$_3$-1a | GalNAc$_3$-1$_a$ | A$_d$ | 2299 |

TABLE 104-continued

Modified ASOs targeting SRB-1

| ISIS No. | Sequences (5' to 3') | GalNAc$_3$ Cluster | CM | SEQ ID No |
|---|---|---|---|---|
| 439879 | T$_{gs}$$^m$C$_{gs}$A$_{ds}$G$_{ds}$T$_{ds}$$^m$C$_{ds}$A$_{ds}$T$_d$ G$_{ds}$A$_{ds}$$^m$C$_{ds}$T$_{ds}$T$_{gs}$$^m$C$_g$ | n/a | n/a | 2298 |
| 699789 | GalNAc$_3$-3$_a$-$_o$,T$_{gs}$$^m$C$_{gs}$A$_{ds}$G$_{ds}$T$_{ds}$$^m$C$_{ds}$A$_{ds}$T$_d$ G$_{ds}$A$_{ds}$$^m$C$_{ds}$T$_{ds}$T$_{gs}$$^m$C$_g$ | GalNAc$_3$-3$_a$ | PO | 2298 |

Subscript "g" indicates a fluoro-HNA nucleoside, subscript "l" indicates a locked nucleoside comprising a 2'-O—CH$_2$-4' bridge. See the Example 74 table legend for other abbreviations. The structure of GalNAc$_3$-1$_a$ was shown previously in Example 9, the structure of GalNAc$_3$-3$_a$ was shown previously in Example 39, and the structure of GalNAc$_3$-7a was shown previously in Example 48.

Treatment

The study was completed using the protocol described in Example 93. Results are shown in Table 105 below and show that oligonucleotides comprising a GalNAc conjugate and various bicyclic nucleoside modifications were significantly more potent than the parent oligonucleotide lacking a conjugate and comprising bicyclic nucleoside modifications. Furthermore, the oligonucleotide comprising a GalNAc conjugate and fluoro-HNA modifications was significantly more potent than the parent lacking a conjugate and comprising fluoro-HNA modifications. The results of the body weights, liver transaminases, total bilirubin, and BUN measurements indicated that the compounds were all well tolerated.

TABLE 105

SRB-1 mRNA, ALT, AST, BUN, and total bilirubin levels and body weights

| ISIS No. | Dosage (mg/kg) | SRB-1 mRNA (% PBS) |
|---|---|---|
| PBS | n/a | 100 |
| 440762 | 1 | 104 |
|  | 3 | 65 |
|  | 10 | 35 |

TABLE 105-continued

SRB-1 mRNA, ALT, AST, BUN, and total bilirubin levels and body weights

| ISIS No. | Dosage (mg/kg) | SRB-1 mRNA (% PBS) |
|---|---|---|
| 666905 | 0.1 | 105 |
|  | 0.3 | 56 |
|  | 1 | 18 |
| 699782 | 0.1 | 93 |
|  | 0.3 | 63 |
|  | 1 | 15 |
| 699783 | 0.1 | 105 |
|  | 0.3 | 53 |
|  | 1 | 12 |
| 653621 | 0.1 | 109 |
|  | 0.3 | 82 |
|  | 1 | 27 |
| 439879 | 1 | 96 |
|  | 3 | 77 |
|  | 10 | 37 |
| 699789 | 0.1 | 82 |
|  | 0.3 | 69 |
|  | 1 | 26 |

Example 96

Plasma Protein Binding of Antisense Oligonucleotides Comprising a GalNAc$_3$ Conjugate Group Oligonucleotides listed in Table 70 targeting ApoC-III and oligonucleotides in Table 106 targeting Apo(a) were tested in an ultra-filtration assay in order to assess plasma protein binding.

TABLE 106

Modified oligonucleotides targeting Apo(a)

| ISIS No. | Sequences (5' to 3') | GalNAc$_3$ Cluster | CM | SEQ ID No |
|---|---|---|---|---|
| 494372 | T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$ T$_{es}$$^m$C$_e$ | n/a | n/a | 2321 |
| 693401 | T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_d$$^m$C$_{ds}$T$_{ds}$T$_{eo}$G$_{eo}$T$_{es}$ T$_{es}$$^m$C$_e$ | n/a | n/a | 2321 |
| 681251 | GalNAc$_3$-7$_a$-$_o$,T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$ T$_{ds}$T$_{es}$G$_{es}$T$_{es}$T$_{es}$$^m$C$_e$ | GalNAc$_3$-7$_a$ | PO | 2321 |
| 681257 | GalNAc$_3$-7$_a$-$_o$,T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$ T$_{ds}$T$_{eo}$G$_{eo}$T$_{es}$T$_{es}$$^m$C$_e$ | GalNAc$_3$-7$_a$ | PO | 2321 |

See the Example 74 for table legend. The structure of GalNAc$_3$-7a was shown previously in Example 48.

Ultrafree-MC ultrafiltration units (30,000 NMWL, low-binding regenerated cellulose membrane, Millipore, Bedford, Mass.) were pre-conditioned with 300 µL of 0.5% Tween 80 and centrifuged at 2000 g for 10 minutes, then with 300 µL of a 300 µg/mL solution of a control oligonucleotide in H$_2$O and centrifuged at 2000 g for 16 minutes. In order to assess non-specific binding to the filters of each test oligonucleotide from Tables 70 and 106 to be used in the studies, 300 µL of a 250 ng/mL solution of oligonucleotide in H$_2$O at pH 7.4 was placed in the pre-conditioned filters and centrifuged at 2000 g for 16 minutes. The unfiltered and filtered samples were analyzed by an ELISA assay to determine the oligonucleotide concentrations. Three replicates were used to obtain an average concentration for each sample. The average concentration of the filtered sample relative to the unfiltered sample is used to determine the percent of oligonucleotide that is recovered through the filter in the absence of plasma (% recovery).

Frozen whole plasma samples collected in K3-EDTA from normal, drug-free human volunteers, cynomolgus monkeys, and CD-1 mice, were purchased from Bioreclamation LLC (Westbury, N.Y.). The test oligonucleotides were added to 1.2 mL aliquots of plasma at two concentrations (5 and 150 µg/mL). An aliquot (300 µL) of each spiked plasma sample was placed in a pre-conditioned filter unit and incubated at 37° C. for 30 minutes, immediately followed by centrifugation at 2000 g for 16 minutes. Aliquots of filtered and unfiltered spiked plasma samples were analyzed by an ELISA to determine the oligonucleotide concentration in each sample. Three replicates per concentration were used to determine the average percentage of bound and unbound oligonucleotide in each sample. The average concentration of the filtered sample relative to the concentration of the unfiltered sample is used to determine the percent of oligonucleotide in the plasma that is not bound to plasma proteins (% unbound). The final unbound oligonucleotide values are corrected for non-specific binding by dividing the % unbound by the % recovery for each oligonucleotide. The final % bound oligonucleotide values are determined by subtracting the final % unbound values from 100. The results are shown in Table 107 for the two concentrations of oligonucleotide tested (5 and 150 µg/mL) in each species of plasma. The results show that GalNAc conjugate groups do not have a significant impact on plasma protein binding. Furthermore, oligonucleotides with full PS internucleoside linkages and mixed PO/PS linkages both bind plasma proteins, and those with full PS linkages bind plasma proteins to a somewhat greater extent than those with mixed PO/PS linkages.

TABLE 107

Percent of modified oligonucleotide bound to plasma proteins

| ISIS No. | Human plasma | | Monkey plasma | | Mouse plasma | |
|---|---|---|---|---|---|---|
| | 5 µg/mL | 150 µg/mL | 5 µg/mL | 150 µg/mL | 5 µg/mL | 150 µg/mL |
| 304801 | 99.2 | 98.0 | 99.8 | 99.5 | 98.1 | 97.2 |
| 663083 | 97.8 | 90.9 | 99.3 | 99.3 | 96.5 | 93.0 |
| 674450 | 96.2 | 97.0 | 98.6 | 94.4 | 94.6 | 89.3 |
| 494372 | 94.1 | 89.3 | 98.9 | 97.5 | 97.2 | 93.6 |
| 693401 | 93.6 | 89.9 | 96.7 | 92.0 | 94.6 | 90.2 |
| 681251 | 95.4 | 93.9 | 99.1 | 98.2 | 97.8 | 96.1 |
| 681257 | 93.4 | 90.5 | 97.6 | 93.7 | 95.6 | 92.7 |

Example 97

Modified Oligonucleotides Targeting TTR Comprising a GalNAc$_3$ Conjugate Group

The oligonucleotides shown in Table 108 comprising a GalNAc conjugate were designed to target TTR.

TABLE 108

Modified oligonucleotides targeting TTR

| ISIS No. | Sequences (5' to 3') | GalNAc$_3$ Cluster | CM | SEQ ID No |
|---|---|---|---|---|
| 666941 | GalNAc$_3$-3$_{a-o}$,A$_{do}$ T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_{e}$ | GalNAc$_3$-3 | A$_d$ | 2322 |
| 666942 | T$_{es}$ $^m$C$_{eo}$ T$_{eo}$ T$_{eo}$ G$_{eo}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{eo}$ T$_{eo}$ $^m$C$_{es}$ $^m$C$_{es}$ $^m$C$_{eo}$ A$_{do}$,-GalNAc$_3$-3$_a$ | GalNAc$_3$-1 | A$_d$ | 2318 |
| 682876 | GalNAc$_3$-3$_{a-o}$,T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_{e}$ | GalNAc$_3$-3 | PO | 2317 |
| 682877 | GalNAc$_3$-7$_{a-o}$,T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_{e}$ | GalNAc$_3$-7 | PO | 2317 |
| 682878 | GalNAc$_3$-10$_{a-o}$,T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_{e}$ | GalNAc$_3$-10 | PO | 2317 |
| 682879 | GalNAc$_3$-13$_{a-o}$,T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_{e}$ | GalNAc$_3$-13 | PO | 2317 |
| 682880 | GalNAc$_3$-7$_{a-o}$,A$_{do}$ T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_{e}$ | GalNAc$_3$-7 | A$_d$ | 2322 |
| 682881 | GalNAc$_3$-10$_{a-o}$,A$_{do}$ T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_{e}$ | GalNAc$_3$-10 | A$_d$ | 2322 |
| 682882 | GalNAc$_3$-13$_{a-o}$,A$_{do}$ T$_{es}$ $^m$C$_{es}$ T$_{es}$ T$_{es}$ G$_{es}$ G$_{ds}$ T$_{ds}$ T$_{ds}$ A$_{ds}$ $^m$C$_{ds}$ A$_{ds}$ T$_{ds}$ G$_{ds}$ A$_{ds}$ A$_{ds}$ A$_{es}$ T$_{es}$ $^m$C$_{es}$ $^m$C$_{es}$ $^m$C$_{e}$ | GalNAc$_3$-13 | A$_d$ | 2322 |

TABLE 108-continued

Modified oligonucleotides targeting TTR

| ISIS No. | Sequences (5' to 3') | GalNAc₃ Cluster | CM | SEQ ID No |
|---|---|---|---|---|
| 684056 | $T_{es}$ $^mC_{es}$ $T_{es}$ $T_{es}$ $G_{es}$ $G_{ds}$ $T_{ds}$ $T_{ds}$ $A_{ds}$ $^mC_{ds}$ $A_{ds}$ $T_{ds}$ $G_{ds}$ $A_{ds}$ $A_{ds}$ $A_{es}$ $T_{es}$ $^mC_{es}$ $^mC_{es}$ $^mC_{eo}$ $A_{do'}$-GalNAc₃-19$_a$ | GalNAc₃-19 | $A_d$ | 2318 |

The legend for Table 108 can be found in Example 74. The structure of GalNAc₃-1 was shown in Example 9. The structure of GalNAc₃-3$_a$ was shown in Example 39. The structure of GalNAc₃-7$_a$ was shown in Example 48. The structure of GalNAc₃-10$_a$ was shown in Example 46. The structure of GalNAc₃-13$_a$ was shown in Example 62. The structure of GalNAc₃-19$_a$ was shown in Example 70.

Example 98

Evaluation of Pro-Inflammatory Effects of Oligonucleotides Comprising a GalNAc Conjugate in hPMBC Assay The oligonucleotides listed in Table 109 and were tested for pro-inflammatory effects in an hPMBC assay as described in Examples 23 and 24. (See Tables 30, 83, 95, and 108 for descriptions of the oligonucleotides.) ISIS 353512 is a high responder used as a positive control, and the other oligonucleotides are described in Tables 83, 95, and 108. The results shown in Table 109 were obtained using blood from one volunteer donor. The results show that the oligonucleotides comprising mixed PO/PS internucleoside linkages produced significantly lower pro-inflammatory responses compared to the same oligonucleotides having full PS linkages. Furthermore, the GalNAc conjugate group did not have a significant effect in this assay.

TABLE 109

| ISIS No. | $E_{max}/EC_{50}$ | GalNAc₃ cluster | Linkages | CM |
|---|---|---|---|---|
| 353512 | 3630 | n/a | PS | n/a |
| 420915 | 802 | n/a | PS | n/a |
| 682881 | 1311 | GalNAc₃-10 | PS | $A_d$ |
| 682888 | 0.26 | GalNAc₃-10 | PO/PS | $A_d$ |
| 684057 | 1.03 | GalNAc₃-19 | PO/PS | $A_d$ |

Example 99

Binding Affinities of Oligonucleotides Comprising a GalNAc Conjugate for the Asialoglycoprotein Receptor The binding affinities of the oligonucleotides listed in Table 110 (see Table 76 for descriptions of the oligonucleotides) for the asialoglycoprotein receptor were tested in a competitive receptor binding assay. The competitor ligand, α1-acid glycoprotein (AGP), was incubated in 50 mM sodium acetate buffer (pH 5) with 1 U neuraminidase-agarose for 16 hours at 37° C., and >90% desialylation was confirmed by either sialic acid assay or size exclusion chromatography (SEC). Iodine monochloride was used to iodinate the AGP according to the procedure by Atsma et al. (see J Lipid Res. 1991 January; 32(1):173-81.) In this method, desialylated α1-acid glycoprotein (de-AGP) was added to 10 mM iodine chloride, Na$^{125}$I, and 1 M glycine in 0.25 M NaOH. After incubation for 10 minutes at room temperature, $^{125}$I-labeled de-AGP was separated from free $^{125}$I by concentrating the mixture twice utilizing a 3 KDM-WCO spin column. The protein was tested for labeling efficiency and purity on a HPLC system equipped with an Agilent SEC-3 column (7.8×300 mm) and a β-RAM counter. Competition experiments utilizing $^{125}$I-labeled de-AGP and various GalNAc-cluster containing ASOs were performed as follows. Human HepG2 cells ($10^6$ cells/ml) were plated on 6-well plates in 2 ml of appropriate growth media. MEM media supplemented with 10% fetal bovine serum (FBS), 2 mM L-Glutamine and 10 mM HEPES was used. Cells were incubated 16-20 hours @ 37° C. with 5% and 10% CO$_2$ respectively. Cells were washed with media without FBS prior to the experiment. Cells were incubated for 30 min @37° C. with 1 ml competition mix containing appropriate growth media with 2% FBS, $10^{-8}$ M $^{125}$I-labeled de-AGP and GalNAc-cluster containing ASOs at concentrations ranging from $10^{-11}$ to $10^{-5}$ M. Non-specific binding was determined in the presence of $10^{-2}$ M GalNAc sugar. Cells were washed twice with media without FBS to remove unbound $^{125}$I-labeled de-AGP and competitor GalNAc ASO. Cells were lysed using Qiagen's RLT buffer containing 1% β-mercaptoethanol. Lysates were transferred to round bottom assay tubes after a brief 10 min freeze/thaw cycle and assayed on a γ-counter. Non-specific binding was subtracted before dividing $^{125}$I protein counts by the value of the lowest GalNAc-ASO concentration counts. The inhibition curves were fitted according to a single site competition binding equation using a nonlinear regression algorithm to calculate the binding affinities ($K_D$'s).

The results in Table 110 were obtained from experiments performed on five different days. Results for oligonucleotides marked with superscript "a" are the average of experiments run on two different days. The results show that the oligonucleotides comprising a GalNAc conjugate group on the 5'-end bound the asialoglycoprotein receptor on human HepG2 cells with 1.5 to 16-fold greater affinity than the oligonucleotides comprising a GalNAc conjugate group on the 3'-end.

TABLE 110

Asialoglycoprotein receptor binding assay results

| ISIS No. | GalNAc conjugate | Oligonucleotide end to which GalNAc conjugate is attached | $K_D$ (nM) |
|---|---|---|---|
| 661161[a] | GalNAc₃-3 | 5' | 3.7 |
| 666881[a] | GalNAc₃-10 | 5' | 7.6 |
| 666981 | GalNAc₃-7 | 5' | 6.0 |
| 670061 | GalNAc₃-13 | 5' | 7.4 |
| 655861[a] | GalNAc₃-1 | 3' | 11.6 |
| 677841[a] | GalNAc₃-19 | 3' | 60.8 |

Example 100

Antisense Inhibition In Vivo by Oligonucleotides Comprising a GalNAc Conjugate Group Targeting Apo(a) In Vivo The oligonucleotides listed in Table 111a below were tested in a single dose study for duration of action in mice.

TABLE 111a

Modified ASOs targeting APO(a)

| ISIS No. | Sequences (5' to 3') | GalNAc$_3$ Cluster | CM | SEQ ID No. |
|---|---|---|---|---|
| 681251 | GalNAc$_3$-7$_a$-$_o$,T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$ T$_{ds}$G$_{ds}$$^m$C$_{ds}$T$_{ds}$T$_{es}$G$_{es}$T$_{es}$T$_{es}$$^m$C$_e$ | GalNAc$_3$-7a | PO | 2321 |
| 681257 | GalNAc$_3$-7$_a$-$_o$,T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$ T$_{ds}$G$_{ds}$$^m$C$_{ds}$T$_{ds}$T$_{eo}$G$_{eo}$T$_{es}$T$_{es}$$^m$C$_e$ | GalNAc$_3$-7a | PO | 2321 |

The structure of GalNAc$_3$-7$_a$ was shown in Example 48.

Treatment

Female transgenic mice that express human Apo(a) were each injected subcutaneously once per week, for a total of 6 doses, with an oligonucleotide and dosage listed in Table 111b or with PBS. Each treatment group consisted of 3 animals. Blood was drawn the day before dosing to determine baseline levels of Apo(a) protein in plasma and at 72 hours, 1 week, and 2 weeks following the first dose. Additional blood draws will occur at 3 weeks, 4 weeks, 5 weeks, and 6 weeks following the first dose. Plasma Apo(a) protein levels were measured using an ELISA. The results in Table 111b are presented as the average percent of plasma Apo(a) protein levels for each treatment group, normalized to baseline levels (% BL), The results show that the oligonucleotides comprising a GalNAc conjugate group exhibited potent reduction in Apo(a) expression. This potent effect was observed for the oligonucleotide that comprises full PS internucleoside linkages and the oligonucleotide that comprises mixed PO and PS linkages.

TABLE 111b

Apo(a) plasma protein levels

| ISIS No. | Dosage (mg/kg) | Apo(a) at 72 hours (% BL) | Apo(a) at 1 week (% BL) | Apo(a) at 3 weeks (% BL) |
|---|---|---|---|---|
| PBS | n/a | 116 | 104 | 107 |
| 681251 | 0.3 | 97 | 108 | 93 |
|  | 1.0 | 85 | 77 | 57 |
|  | 3.0 | 54 | 49 | 11 |
|  | 10.0 | 23 | 15 | 4 |
| 681257 | 0.3 | 114 | 138 | 104 |
|  | 1.0 | 91 | 98 | 54 |
|  | 3.0 | 69 | 40 | 6 |
|  | 10.0 | 30 | 21 | 4 |

Example 101

Antisense Inhibition by Oligonucleotides Comprising a GalNAc Cluster Linked Via a Stable Moiety The oligonucleotides listed in Table 112 were tested for inhibition of mouse APOC-III expression in vivo. C57Bl/6 mice were each injected subcutaneously once with an oligonucleotide listed in Table 112 or with PBS. Each treatment group consisted of 4 animals. Each mouse treated with ISIS 440670 received a dose of 2, 6, 20, or 60 mg/kg. Each mouse treated with ISIS 680772 or 696847 received 0.6, 2, 6, or 20 mg/kg. The GalNAc conjugate group of ISIS 696847 is linked via a stable moiety, a phosphorothioate linkage instead of a readily cleavable phosphodiester containing linkage. The animals were sacrificed 72 hours after the dose. Liver APOC-III mRNA levels were measured using real-time PCR. APOC-III mRNA levels were normalized to cyclophilin mRNA levels according to standard protocols. The results are presented in Table 112 as the average percent of APOC-III mRNA levels for each treatment group relative to the saline control group. The results show that the oligonucleotides comprising a GalNAc conjugate group were significantly more potent than the oligonucleotide lacking a conjugate group. Furthermore, the oligonucleotide comprising a GalNAc conjugate group linked to the oligonucleotide via a cleavable moiety (ISIS 680772) was even more potent than the oligonucleotide comprising a GalNAc conjugate group linked to the oligonucleotide via a stable moiety (ISIS 696847).

TABLE 112

Modified oligonucleotides targeting mouse APOC-III

| ISIS No. | Sequences (5' to 3') | CM | Dosage (mg/kg) | APOC-III mRNA (% PBS) | SEQ ID No. |
|---|---|---|---|---|---|
| 440670 | $^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$ G$_{ds}$G$_{ds}$G$_{ds}$A$_{ds}$$^m$C$_{es}$A$_{es}$G$_{es}$$^m$C$_{es}$A$_e$ | n/a | 2 | 92 | 2324 |
|  |  |  | 6 | 86 |  |
|  |  |  | 20 | 59 |  |
|  |  |  | 60 | 37 |  |

TABLE 112-continued

Modified oligonucleotides targeting mouse APOC-III

| ISIS No. | Sequences (5' to 3') | CM | Dosage (mg/kg) | APOC-III mRNA (% PBS) | SEQ ID No. |
|---|---|---|---|---|---|
| 680772 | GalNAc$_3$-7$_{a-o}$,$^m$C$_{es}$A$_{es}$G$_{es}$$^m$C$_{es}$T$_{es}$T$_{ds}$T$_{ds}$A$_{ds}$ T$_{ds}$T$_{ds}$A$_{ds}$G$_{ds}$ G$_{ds}$G$_{ds}$A$_{ds}$$^m$C$_{es}$ A$_{es}$G$_{es}$$^m$C$_{es}$A$_e$ | PO | 0.6<br>2<br>6<br>20 | 79<br>58<br>31<br>13 | 2324 |
| 696847 | GalNAc$_3$-7$_{a-s}$,$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$ G$_{ds}$G$_{ds}$A$_{ds}$$^m$C$_{es}$ A$_{es}$G$_{es}$$^m$C$_{es}$A$_e$ | n/a (PS) | 0.6<br>2<br>6<br>20 | 83<br>73<br>40<br>28 | 2324 |

The structure of GalNAc$_3$-7$_a$ was shown in Example 48.

Example 102

Distribution in Liver of Antisense Oligonucleotides Comprising a GalNAc Conjugate The liver distribution of ISIS 353382 (see Table 36) that does not comprise a GalNAc conjugate and ISIS 655861 (see Table 36) that does comprise a GalNAc conjugate was evaluated. Male Balb/c mice were subcutaneously injected once with ISIS 353382 or 655861 at a dosage listed in Table 113. Each treatment group consisted of 3 animals except for the 18 mg/kg group for ISIS 655861, which consisted of 2 animals. The animals were sacrificed 48 hours following the dose to determine the liver distribution of the oligonucleotides. In order to measure the number of antisense oligonucleotide molecules per cell, a Ruthenium (II) tris-bipyridine tag (MSD TAG, Meso Scale Discovery) was conjugated to an oligonucleotide probe used to detect the antisense oligonucleotides. The results presented in Table 113 are the average concentrations of oligonucleotide for each treatment group in units of millions of oligonucleotide molecules per cell. The results show that at equivalent doses, the oligonucleotide comprising a GalNAc conjugate was present at higher concentrations in the total liver and in hepatocytes than the oligonucleotide that does not comprise a GalNAc conjugate. Furthermore, the oligonucleotide comprising a GalNAc conjugate was present at lower concentrations in non-parenchymal liver cells than the oligonucleotide that does not comprise a GalNAc conjugate. And while the concentrations of ISIS 655861 in hepatocytes and non-parenchymal liver cells were similar per cell, the liver is approximately 80% hepatocytes by volume. Thus, the majority of the ISIS 655861 oligonucleotide that was present in the liver was found in hepatocytes, whereas the majority of the ISIS 353382 oligonucleotide that was present in the liver was found in non-parenchymal liver cells.

TABLE 113

| ISIS No. | Dosage (mg/kg) | Concentration in whole liver (molecules * 10$^{\wedge}$6 per cell) | Concentration in hepatocytes (molecules * 10$^{\wedge}$6 per cell) | Concentration in non-parenchymal liver cells (molecules * 10$^{\wedge}$6 per cell) |
|---|---|---|---|---|
| 353382 | 3 | 9.7 | 1.2 | 37.2 |
|  | 10 | 17.3 | 4.5 | 34.0 |
|  | 20 | 23.6 | 6.6 | 65.6 |
|  | 30 | 29.1 | 11.7 | 80.0 |
|  | 60 | 73.4 | 14.8 | 98.0 |
|  | 90 | 89.6 | 18.5 | 119.9 |
| 655861 | 0.5 | 2.6 | 2.9 | 3.2 |
|  | 1 | 6.2 | 7.0 | 8.8 |
|  | 3 | 19.1 | 25.1 | 28.5 |
|  | 6 | 44.1 | 48.7 | 55.0 |
|  | 18 | 76.6 | 82.3 | 77.1 |

Example 103

Duration of Action In Vivo of Oligonucleotides Targeting APOC-III Comprising a GalNAc$_3$ Conjugate The oligonucleotides listed in Table 114 below were tested in a single dose study for duration of action in mice.

TABLE 114

Modified ASOs targeting APOC-III

| ISIS No. | Sequences (5' to 3') | GalNAc$_3$ Cluster | CM | SEQ ID No. |
|---|---|---|---|---|
| 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$ T$_{es}$A$_{es}$T$_e$ | n/a | n/a | 2296 |
| 663084 | GalNAc$_3$-3$_{a-o}$,A$_{do}$A$_{es}$G$_{eo}$$^m$C$_{eo}$T$_{eo}$T$_{eo}$$^m$C$_{ds}$T$_{ds}$T$_{ds}$G$_{ds}$T$_{ds}$$^m$C$_{ds}$ $^m$C$_{ds}$A$_{ds}$G$_{ds}$$^m$C$_{ds}$T$_{eo}$T$_{eo}$ T$_{es}$A$_{es}$T$_e$ | GalNAc$_3$-3a | A$_d$ | 2312 |

TABLE 114-continued

Modified ASOs targeting APOC-III

| ISIS No. | Sequences (5' to 3') | GalNAc$_3$ Cluster | CM | SEQ ID No. |
|---|---|---|---|---|
| 679241 | A$_{es}$G$_{eo}$$^m$C$_{eo}$T$_{eo}$T$_{eo}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{eo}$T$_{eo}$T$_{es}$A$_{es}$T$_{eo}$A$_{do}$,-GalNAc$_3$-19$_a$ | GalNAc$_3$-19a | A$_d$ | 2297 |

The structure of GalNAc$_3$-3$_a$ was shown in Example 39, and GalNAc$_3$-19$_a$ was shown in Example 70.

Treatment

Female transgenic mice that express human APOC-III were each injected subcutaneously once with an oligonucleotide listed in Table 114 or with PBS. Each treatment group consisted of 3 animals. Blood was drawn before dosing to determine baseline and at 3, 7, 14, 21, 28, 35, and 42 days following the dose. Plasma triglyceride and APOC-III protein levels were measured as described in Example 20. The results in Table 115 are presented as the average percent of plasma triglyceride and APOC-III levels for each treatment group, normalized to baseline levels. A comparison of the results in Table 71 of example 79 with the results in Table 115 below show that oligonucleotides comprising a mixture of phosphodiester and phosphorothioate internucleoside linkages exhibited increased duration of action than equivalent oligonucleotides comprising only phosphorothioate internucleoside linkages.

TABLE 115

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc$_3$ Cluster | CM |
|---|---|---|---|---|---|---|
| PBS | n/a | 3 | 96 | 101 | n/a | n/a |
|  |  | 7 | 88 | 98 |  |  |
|  |  | 14 | 91 | 103 |  |  |
|  |  | 21 | 69 | 92 |  |  |
|  |  | 28 | 83 | 81 |  |  |

TABLE 115-continued

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc$_3$ Cluster | CM |
|---|---|---|---|---|---|---|
|  |  | 35 | 65 | 86 |  |  |
|  |  | 42 | 72 | 88 |  |  |
| 304801 | 30 | 3 | 42 | 46 | n/a | n/a |
|  |  | 7 | 42 | 51 |  |  |
|  |  | 14 | 59 | 69 |  |  |
|  |  | 21 | 67 | 81 |  |  |
|  |  | 28 | 79 | 76 |  |  |
|  |  | 35 | 72 | 95 |  |  |
|  |  | 42 | 82 | 92 |  |  |
| 663084 | 10 | 3 | 35 | 28 | GalNAc$_3$-3a | A$_d$ |
|  |  | 7 | 23 | 24 |  |  |
|  |  | 14 | 23 | 26 |  |  |
|  |  | 21 | 23 | 29 |  |  |
|  |  | 28 | 30 | 22 |  |  |
|  |  | 35 | 32 | 36 |  |  |
|  |  | 42 | 37 | 47 |  |  |
| 679241 | 10 | 3 | 38 | 30 | GalNAc$_3$-19a | A$_d$ |
|  |  | 7 | 31 | 28 |  |  |
|  |  | 14 | 30 | 22 |  |  |
|  |  | 21 | 36 | 34 |  |  |
|  |  | 28 | 48 | 34 |  |  |
|  |  | 35 | 50 | 45 |  |  |
|  |  | 42 | 72 | 64 |  |  |

Example 104

Synthesis of Oligonucleotides Comprising a 5'-GalNAc$_2$ Conjugate

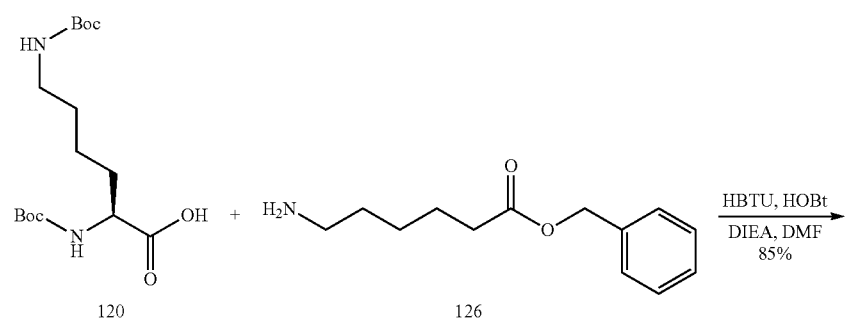

-continued
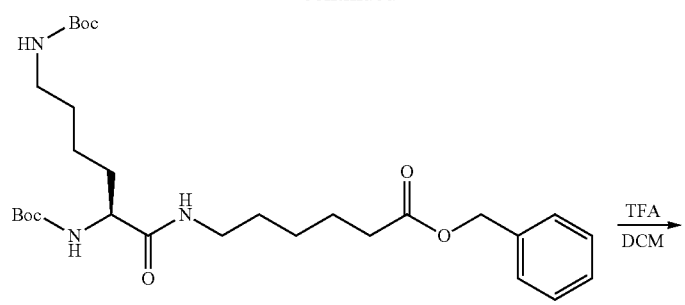
231
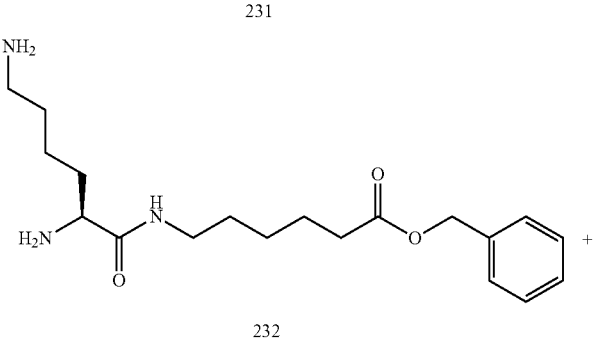
232
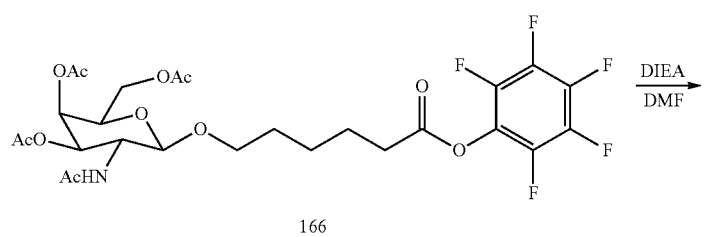
166
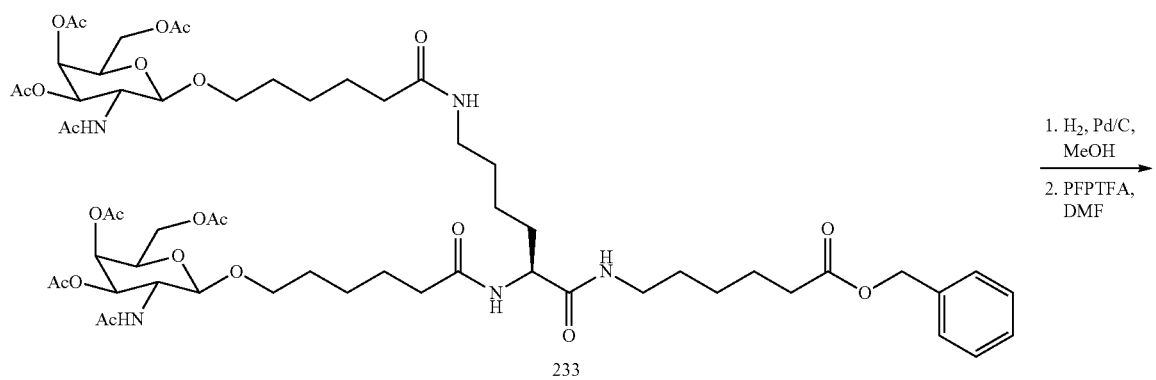
233
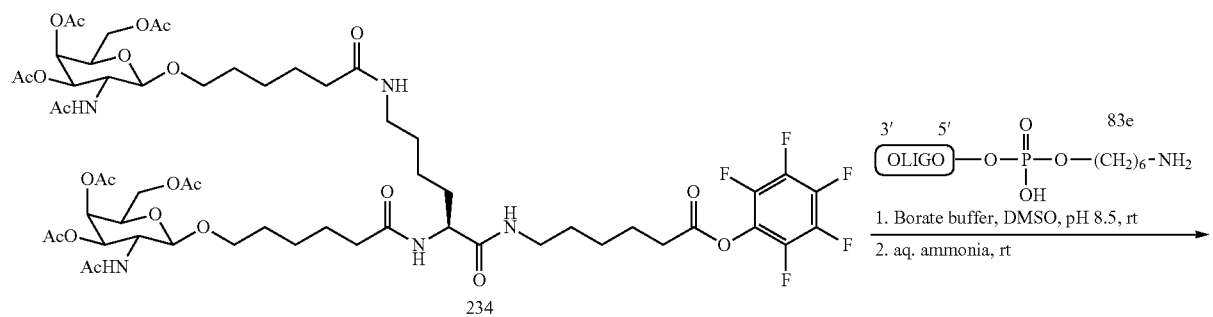
234

-continued

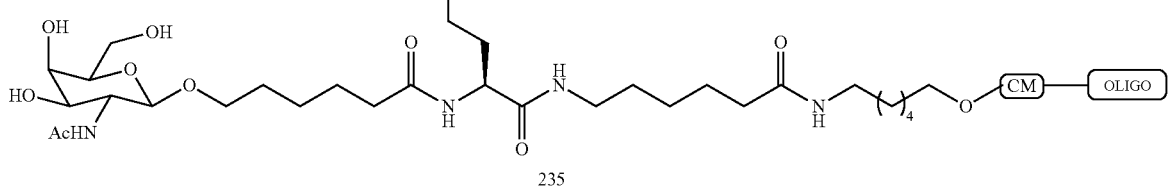

235

Compound 120 is commercially available, and the synthesis of compound 126 is described in Example 49. Compound 120 (1 g, 2.89 mmol), HBTU (0.39 g, 2.89 mmol), and HOBt (1.64 g, 4.33 mmol) were dissolved in DMF (10 mL. and N,N-diisopropylethylamine (1.75 mL, 10.1 mmol) were added. After about 5 min, aminohexanoic acid benzyl ester (1.36 g, 3.46 mmol) was added to the reaction. After 3 h, the reaction mixture was poured into 100 mL of 1 M NaHSO4 and extracted with 2×50 mL ethyl acetate. Organic layers were combined and washed with 3×40 mL sat NaHCO₃ and 2× brine, dried with Na₂SO₄, filtered and concentrated. The product was purified by silica gel column chromatography (DCM:EA:Hex, 1:1:1) to yield compound 231. LCMS and NMR were consistent with the structure. Compounds 231 (1.34 g, 2.438 mmol) was dissolved in dichloromethane (10 mL) and trifluoracetic acid (10 mL) was added. After stirring at room temperature for 2 h, the reaction mixture was concentrated under reduced pressure and co-evaporated with toluene (3×10 mL). The residue was dried under reduced pressure to yield compound 232 as the trifuloracetate salt. The synthesis of compound 166 is described in Example 54. Compound 166 (3.39 g, 5.40 mmol) was dissolved in DMF (3 mL). A solution of compound 232 (1.3 g, 2.25 mmol) was dissolved in DMF (3 mL) and N,N-diisopropylethylamine (1.55 mL) was added. The reaction was stirred at room temperature for 30 minutes, then poured into water (80 mL) and the aqueous layer was extracted with EtOAc (2×100 mL). The organic phase was separated and washed with sat. aqueous NaHCO₃ (3×80 mL), 1 M NaHSO₄ (3×80 mL) and brine (2×80 mL), then dried (Na₂SO₄), filtered, and concentrated. The residue was purified by silica gel column chromatography to yield compound 233. LCMS and NMR were consistent with the structure. Compound 233 (0.59 g, 0.48 mmol) was dissolved in methanol (2.2 mL) and ethyl acetate (2.2 mL). Palladium on carbon (10 wt % Pd/C, wet, 0.07 g) was added, and the reaction mixture was stirred under hydrogen atmosphere for 3 h. The reaction mixture was filtered through a pad of Celite and concentrated to yield the carboxylic acid. The carboxylic acid (1.32 g, 1.15 mmol, cluster free acid) was dissolved in DMF (3.2 mL). To this N,N-diisopropylehtylamine (0.3 mL, 1.73 mmol) and PFPTFA (0.30 mL, 1.73 mmol) were added. After 30 min stirring at room temperature the reaction mixture was poured into water (40 mL) and extracted with EtOAc (2×50 mL). A standard work-up was completed as described above to yield compound 234. LCMS and NMR were consistent with the structure. Oligonucleotide 235 was prepared using the general procedure described in Example 46. The GalNAc₂ cluster portion (GalNAc₂-24ₐ) of the conjugate group GalNAc₂-24 can be combined with any cleavable moiety present on the oligonucleotide to provide a variety of conjugate groups. The structure of GalNAc₂-24 (GalNAc₂-24ₐ-CM) is shown below:

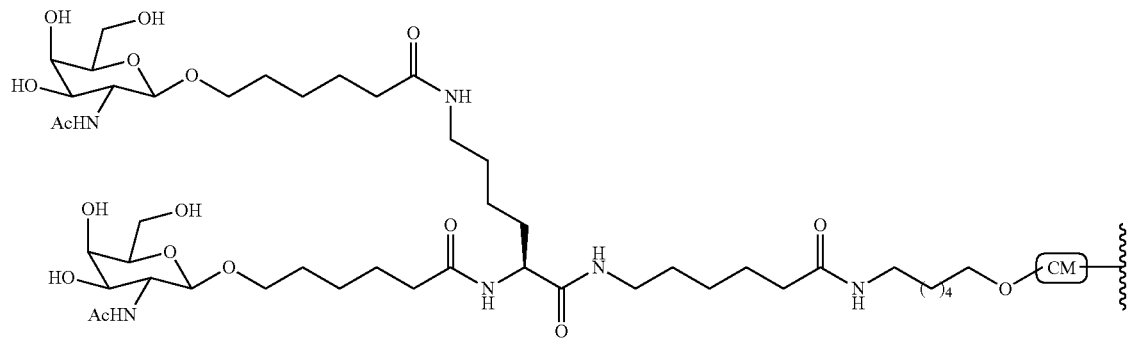

Example 105

Synthesis of Oligonucleotides Comprising a GalNAc$_1$-25 Conjugate

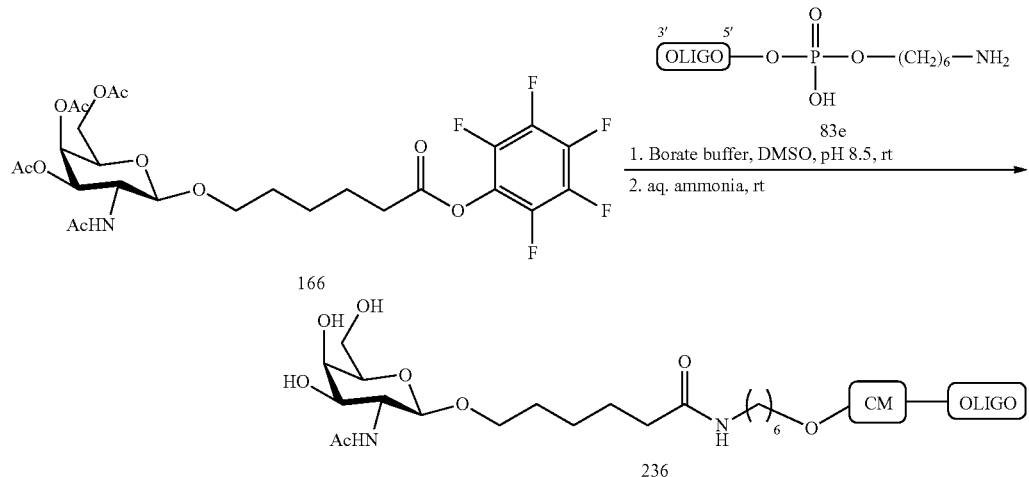

The synthesis of compound 166 is described in Example 54. Oligonucleotide 236 was prepared using the general procedure described in Example 46. Alternatively, oligonucleotide 236 was synthesized using the scheme shown below, and compound 238 was used to form the oligonucleotide 236 using procedures described in Example 10.

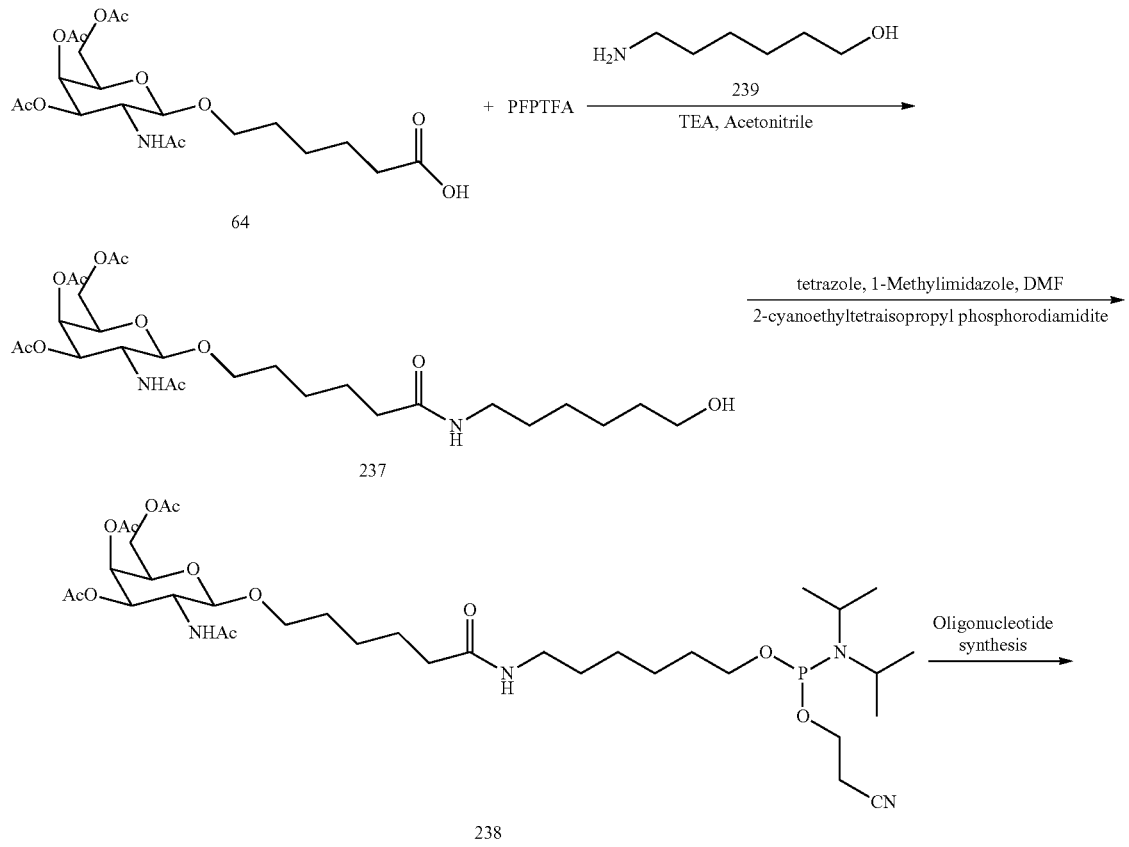

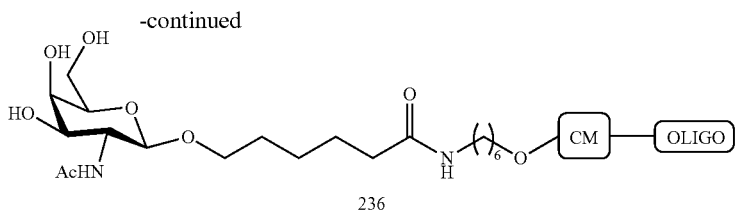

236

The GalNAc$_1$ cluster portion (GalNAc$_1$-25$_a$) of the conjugate group GalNAc$_1$-25 can be combined with any cleavable moiety present on the oligonucleotide to provide a variety of conjugate groups. The structure of GalNAc$_1$-25 (GalNAc$_1$-25$_a$-CM) is shown below:

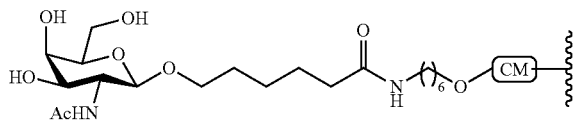

Example 106

Antisense Inhibition In Vivo by Oligonucleotides Targeting SRB-1 Comprising a 5-GalNAc$_2$ or a 5'-GalNAc$_3$ Conjugate Oligonucleotides listed in Tables 116 and 117 were tested in dose-dependent studies for antisense inhibition of SRB-1 in mice.

Treatment

Six to week old, male C57BL/6 mice (Jackson Laboratory, Bar Harbor, Me.) were injected subcutaneously once with 2, 7, or 20 mg/kg of ISIS No. 440762; or with 0.2, 0.6, 2, 6, or 20 mg/kg of ISIS No. 686221, 686222, or 708561; or with saline. Each treatment group consisted of 4 animals. The mice were sacrificed 72 hours following the final administration. Liver SRB-1 mRNA levels were measured using real-time PCR. SRB-1 mRNA levels were normalized to cyclophilin mRNA levels according to standard protocols. The antisense oligonucleotides lowered SRB-1 mRNA levels in a dose-dependent manner, and the ED$_{50}$ results are presented in Tables 116 and 117. Although previous studies showed that trivalent GalNAc-conjugated oligonucleotides were significantly more potent than divalent GalNAc-conjugated oligonucleotides, which were in turn significantly more potent than monovalent GalNAc conjugated oligonucleotides (see, e.g., Khorev et al., Bioorg. & Med. Chem., Vol. 16, 5216-5231 (2008)), treatment with antisense oligonucleotides comprising monovalent, divalent, and trivalent GalNAc clusters lowered SRB-1 mRNA levels with similar potencies as shown in Tables 116 and 117.

TABLE 116

Modified oligonucleotides targeting SRB-1

| ISIS No. | Sequences (5' to 3') | GalNAc Cluster | ED$_{50}$ (mg/kg) | SEQ ID No |
|---|---|---|---|---|
| 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | n/a | 4.7 | 2298 |
| 686221 | GalNAc$_2$-24$_a$-$_o$,A$_{do}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{ks}$$^m$C$_k$ | GalNAc$_2$-24$_a$ | 0.39 | 2302 |
| 686222 | GalNAc$_3$-13$_a$-$_o$,A$_{do}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{ks}$$^m$C$_k$ | GalNAc$_3$-13$_a$ | 0.41 | 2302 |

See Example 93 for table legend. The structure of GalNAc$_3$-13a was shown in Example 62, and the structure of GalNAc$_2$-24a was shown in Example 104.

TABLE 117

Modified oligonucleotides targeting SRB-1

| ISIS No. | Sequences (5' to 3') | GalNAc Cluster | ED$_{50}$ (mg/kg) | SEQ ID No |
|---|---|---|---|---|
| 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | n/a | 5 | 2298 |
| 708561 | GalNAc$_1$-25$_a$-$_o$,T$_{ks}$$^m$C$_{ks}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{ks}$$^m$C$_k$ | GalNAc$_1$-25$_a$ | 0.4 | 2298 |

See Example 93 for table legend. The structure of GalNAc$_1$-25a was shown in Example 105.

The concentrations of the oligonucleotides in Tables 116 and 117 in liver were also assessed, using procedures described in Example 75. The results shown in Tables 117a and 117b below are the average total antisense oligonucleotide tissues levels for each treatment group, as measured by UV in units of μg oligonucleotide per gram of liver tissue. The results show that the oligonucleotides comprising a GalNAc conjugate group accumulated in the liver at significantly higher levels than the same dose of the oligonucleotide lacking a GalNAc conjugate group. Furthermore, the antisense oligonucleotides comprising one, two, or three GalNAc ligands in their respective conjugate groups all accumulated in the liver at similar levels. This result is surprising in view of the Khorev et al. literature reference cited above and is consistent with the activity data shown in Tables 116 and 117 above.

TABLE 117a

Liver concentrations of oligonucleotides comprising a GalNAc$_2$ or GalNAc$_3$ conjugate group

| ISIS No. | Dosage (mg/kg) | Antisense oligonucleotide (μg/g) | GalNAc cluster | CM |
|---|---|---|---|---|
| 440762 | 2 | 2.1 | n/a | n/a |
| | 7 | 13.1 | | |
| | 20 | 31.1 | | |
| 686221 | 0.2 | 0.9 | GalNAc$_2$-24$_a$ | A$_d$ |
| | 0.6 | 2.7 | | |
| | 2 | 12.0 | | |
| | 6 | 26.5 | | |

TABLE 117a-continued

Liver concentrations of oligonucleotides comprising a GalNAc$_2$ or GalNAc$_3$ conjugate group

| ISIS No. | Dosage (mg/kg) | Antisense oligonucleotide (μg/g) | GalNAc cluster | CM |
|---|---|---|---|---|
| 686222 | 0.2 | 0.5 | GalNAc$_3$-13$_a$ | A$_d$ |
| | 0.6 | 1.6 | | |
| | 2 | 11.6 | | |
| | 6 | 19.8 | | |

TABLE 117b

Liver concentrations of oligonucleotides comprising a GalNAc$_1$ conjugate group

| ISIS No. | Dosage (mg/kg) | Antisense oligonucleotide (μg/g) | GalNAc cluster | CM |
|---|---|---|---|---|
| 440762 | 2 | 2.3 | n/a | n/a |
| | 7 | 8.9 | | |
| | 20 | 23.7 | | |
| 708561 | 0.2 | 0.4 | GalNAc$_1$-25$_a$ | PO |
| | 0.6 | 1.1 | | |
| | 2 | 5.9 | | |
| | 6 | 23.7 | | |
| | 20 | 53.9 | | |

Example 107

Synthesis of Oligonucleotides Comprising a GalNAc$_1$-26 or GalNAc$_1$-27 Conjugate

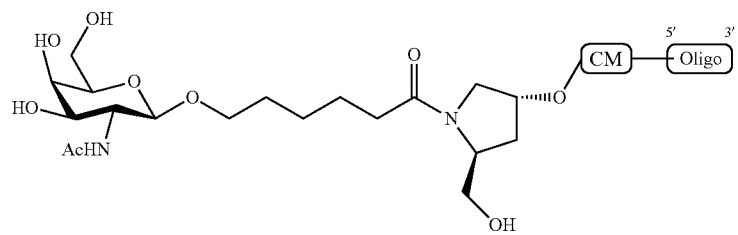

239

Oligonucleotide 239 is synthesized via coupling of compound 47 (see Example 15) to acid 64 (see Example 32) using HBTU and DIEA in DMF. The resulting amide containing compound is phosphitylated, then added to the 5'-end of an oligonucleotide using procedures described in Example 10. The GalNAc$_1$ cluster portion (GalNAc$_1$-26$_a$) of the conjugate group GalNAc$_1$-26 can be combined with any cleavable moiety present on the oligonucleotide to provide a variety of conjugate groups. The structure of GalNAc$_1$-26 (GalNAc$_1$-26$_a$-CM) is shown below:

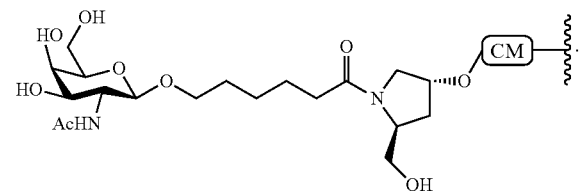

In order to add the GalNAc$_1$ conjugate group to the 3'-end of an oligonucleotide, the amide formed from the reaction of compounds 47 and 64 is added to a solid support using procedures described in Example 7. The oligonucleotide synthesis is then completed using procedures described in Example 9 in order to form oligonucleotide 240.

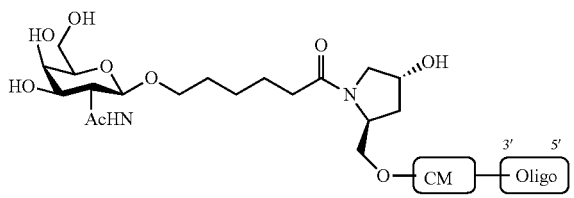

240

The GalNAc$_1$ cluster portion (GalNAc$_1$-27$_a$) of the conjugate group GalNAc$_1$-27 can be combined with any cleavable moiety present on the oligonucleotide to provide a variety of conjugate groups. The structure of GalNAc$_1$-27 (GalNAc$_1$-27$_a$-CM) is shown below:

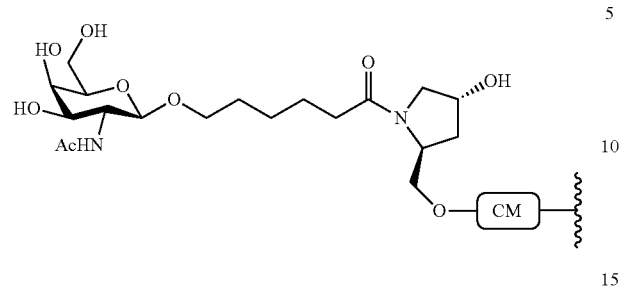

Example 108

Antisense Inhibition In Vivo by Oligonucleotides Comprising a GalNAc Conjugate Group Targeting Apo(a) In Vivo The oligonucleotides listed in Table 118 below were tested in a single dose study in mice.

TABLE 118

Modified ASOs targeting APO(a)

| ISIS No. | Sequences (5' to 3') | GalNAc$_3$ Cluster | CM | SEQ ID No. |
|---|---|---|---|---|
| 494372 | T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_{e}$ | n/a | n/a | 2321 |
| 681251 | GalNAc$_3$-7$_a$-$_o$,T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_{e}$ | GalNAc$_3$-7a | PO | 2321 |
| 681255 | GalNAc$_3$-3$_a$-$_o$,T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{e}$ | GalNAc$_3$-3a | PO | 2321 |
| 681256 | GalNAc$_3$-10$_a$-$_o$,T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{e}$ | GalNAc$_3$-10a | PO | 2321 |
| 681257 | GalNAc$_3$-7$_a$-$_o$,T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{e}$ | GalNAc$_3$-7a | PO | 2321 |
| 681258 | GalNAc$_3$-13$_a$-$_o$,T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{e}$ | GalNAc$_3$-13a | PO | 2321 |
| 681260 | T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{eo}$A$_{do}$,-GalNAc$_3$-19 | GalNAc$_3$-19a | A$_d$ | 2328 |

The structure of GalNAc$_3$-7$_a$ was shown in Example 48.

Treatment

Male transgenic mice that express human Apo(a) were each injected subcutaneously once with an oligonucleotide and dosage listed in Table 119 or with PBS. Each treatment group consisted of 4 animals. Blood was drawn the day before dosing to determine baseline levels of Apo(a) protein in plasma and at 1 week following the first dose. Additional blood draws will occur weekly for approximately 8 weeks. Plasma Apo(a) protein levels were measured using an ELISA. The results in Table 119 are presented as the average percent of plasma Apo(a) protein levels for each treatment group, normalized to baseline levels (% BL). The results show that the antisense oligonucleotides reduced Apo(a) protein expression. Furthermore, the oligonucleotides comprising a GalNAc conjugate group exhibited even more potent reduction in Apo(a) expression than the oligonucleotide that does not comprise a conjugate group.

TABLE 119

| | Apo(a) plasma protein levels | |
|---|---|---|
| ISIS No. | Dosage (mg/kg) | Apo(a) at 1 week (% BL) |
| PBS | n/a | 143 |
| 494372 | 50 | 58 |
| 681251 | 10 | 15 |
| 681255 | 10 | 14 |
| 681256 | 10 | 17 |
| 681257 | 10 | 24 |
| 681258 | 10 | 22 |
| 681260 | 10 | 26 |

Example 109

Synthesis of Oligonucleotides Comprising a GalNAc$_1$-28 or GalNAc$_1$-29 Conjugate

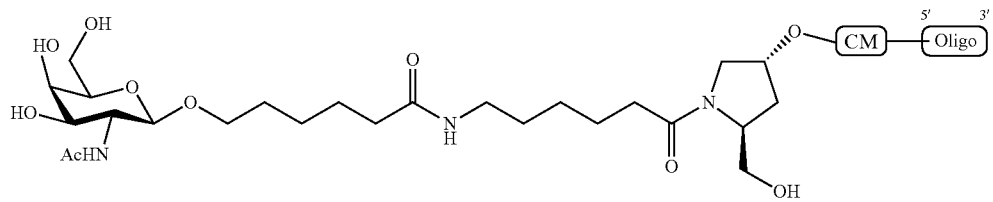

241

Oligonucleotide 241 is synthesized using procedures similar to those described in Example 71 to form the phosphoramidite intermediate, followed by procedures described in Example 10 to synthesize the oligonucleotide. The GalNAc$_1$ cluster portion (GalNAc$_1$-28$_a$) of the conjugate group GalNAc$_1$-28 can be combined with any cleavable moiety present on the oligonucleotide to provide a variety of conjugate groups. The structure of GalNAc$_1$-28 (GalNAc$_1$-28$_a$-CM) is shown below:

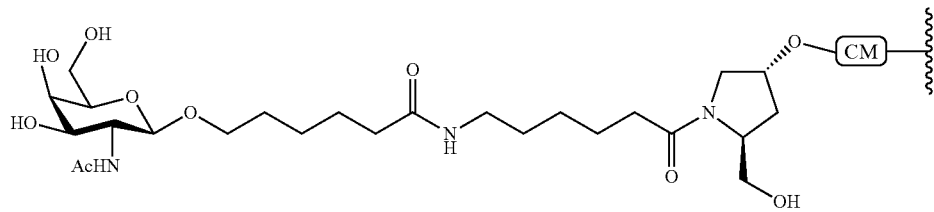

In order to add the GalNAc$_1$ conjugate group to the 3'-end of an oligonucleotide, procedures similar to those described in Example 71 are used to form the hydroxyl intermediate, which is then added to the solid support using procedures described in Example 7. The oligonucleotide synthesis is then completed using procedures described in Example 9 in order to form oligonucleotide 242.

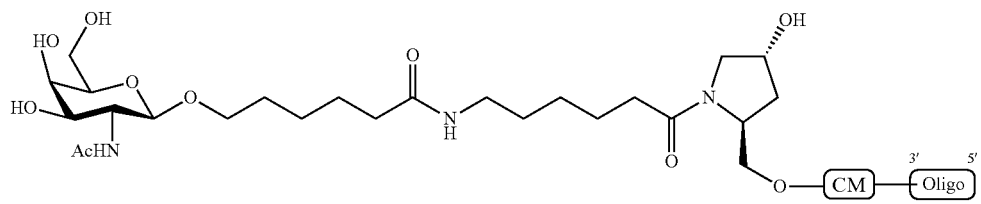

242

The GalNAc$_1$ cluster portion (GalNAc$_1$-29$_a$) of the conjugate group GalNAc$_1$-29 can be combined with any cleavable moiety present on the oligonucleotide to provide a variety of conjugate groups. The structure of GalNAc$_1$-29 (GalNAc$_1$-29$_a$-CM) is shown below:

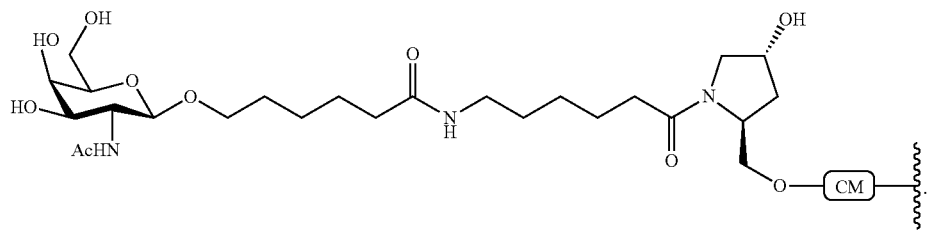

Example 110

Synthesis of Oligonucleotides Comprising a GalNAc$_1$-30 Conjugate

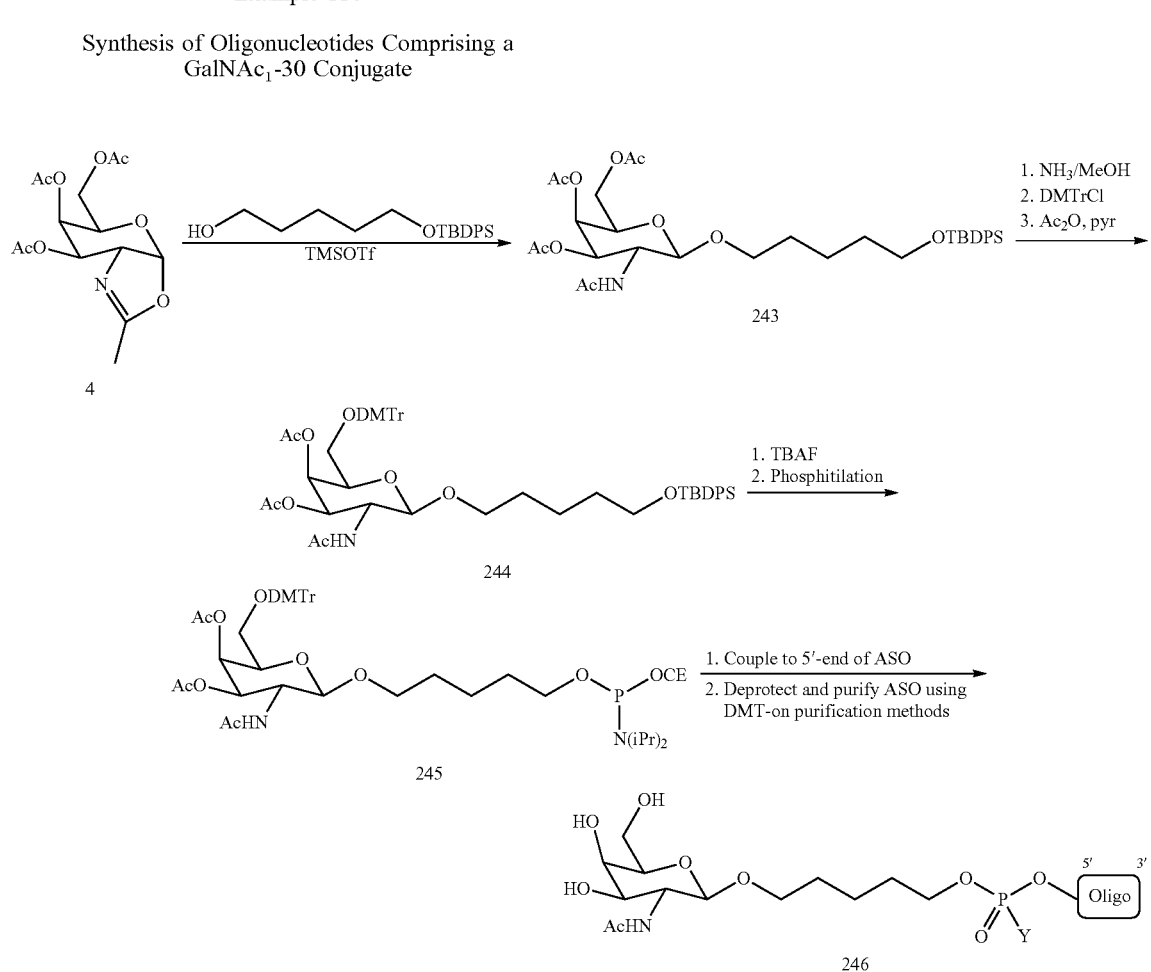

Oligonucleotide 246 comprising a GalNAc$_1$-30 conjugate group, wherein Y is selected from O, S, a substituted or unsubstituted C$_1$-C$_{10}$ alkyl, amino, substituted amino, azido, alkenyl or alkynyl, is synthesized as shown above. The GalNAc$_1$ cluster portion (GalNAc$_1$-30$_a$) of the conjugate group GalNAc$_1$-30 can be combined with any cleavable moiety to provide a variety of conjugate groups. In certain embodiments, Y is part of the cleavable moiety. In certain embodiments, Y is part of a stable moiety, and the cleavable moiety is present on the oligonucleotide. The structure of GalNAc$_1$-30$_a$ is shown below:

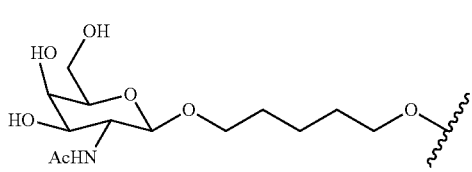 [SMILES: *OCCCCCOC1OC(CO)C(O)C(O)C1NC(C)=O]

Example 111

Synthesis of Oligonucleotides Comprising a GalNAc$_2$-31 or GalNAc$_2$-32 Conjugate

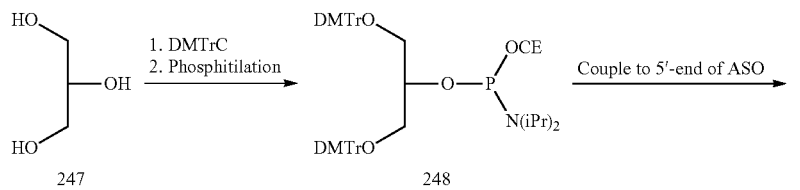

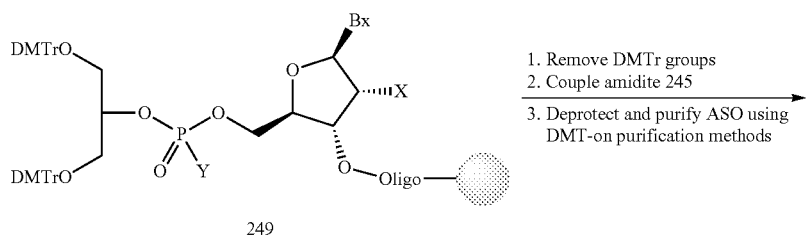

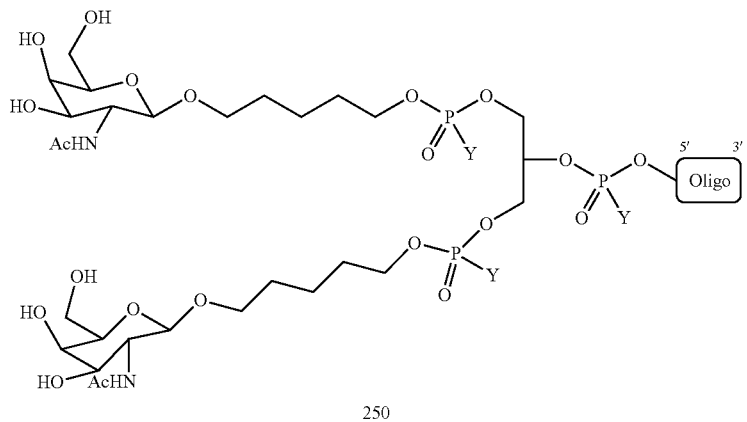

Oligonucleotide 250 comprising a GalNAc$_2$-31 conjugate group, wherein Y is selected from O, S, a substituted or unsubstituted $C_1$-$C_{10}$ alkyl, amino, substituted amino, azido, alkenyl or alkynyl, is synthesized as shown above. The GalNAc$_2$ cluster portion (GalNAc$_2$-31$_a$) of the conjugate group GalNAc$_2$-31 can be combined with any cleavable moiety to provide a variety of conjugate groups. In certain embodiments, the Y-containing group directly adjacent to the 5'-end of the oligonucleotide is part of the cleavable moiety. In certain embodiments, the Y-containing group directly adjacent to the 5'-end of the oligonucleotide is part of a stable moiety, and the cleavable moiety is present on the oligonucleotide. The structure of GalNAc$_2$-31$_a$ is shown below:

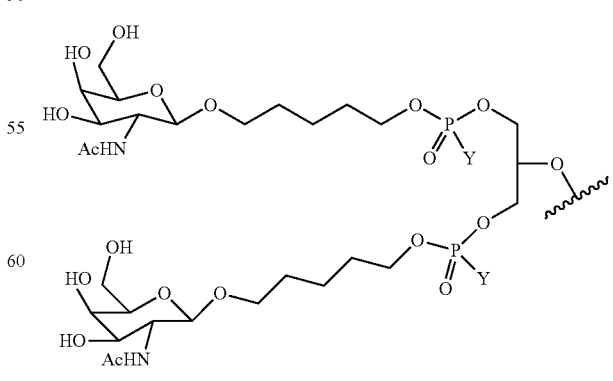

The synthesis of an oligonucleotide comprising a Gal-NAc$_2$-32 conjugate is shown below.

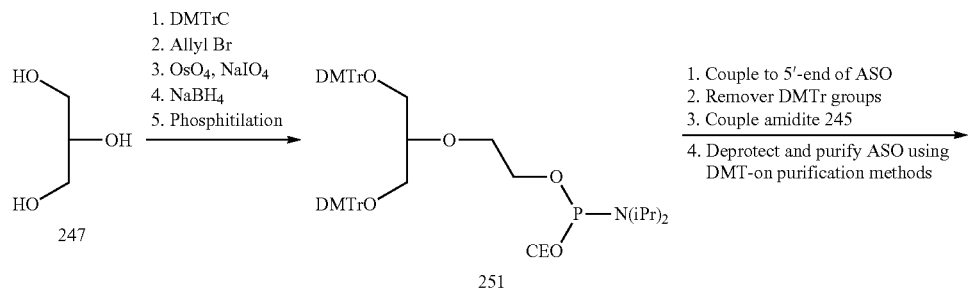

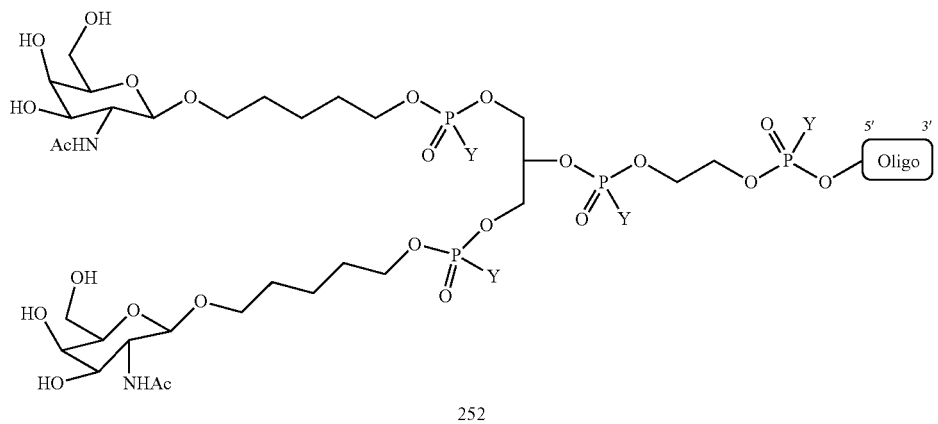

252

Oligonucleotide 252 comprising a GalNAc$_2$-32 conjugate group, wherein Y is selected from O, S, a substituted or unsubstituted C$_1$-C$_{10}$ alkyl, amino, substituted amino, azido, alkenyl or alkynyl, is synthesized as shown above. The GalNAc$_2$ cluster portion (GalNAc$_2$-32$_a$) of the conjugate group GalNAc$_2$-32 can be combined with any cleavable moiety to provide a variety of conjugate groups. In certain embodiments, the Y-containing group directly adjacent to the 5'-end of the oligonucleotide is part of the cleavable moiety. In certain embodiments, the Y-containing group directly adjacent to the 5'-end of the oligonucleotide is part of a stable moiety, and the cleavable moiety is present on the oligonucleotide. The structure of GalNAc$_2$-32$_a$ is shown below:

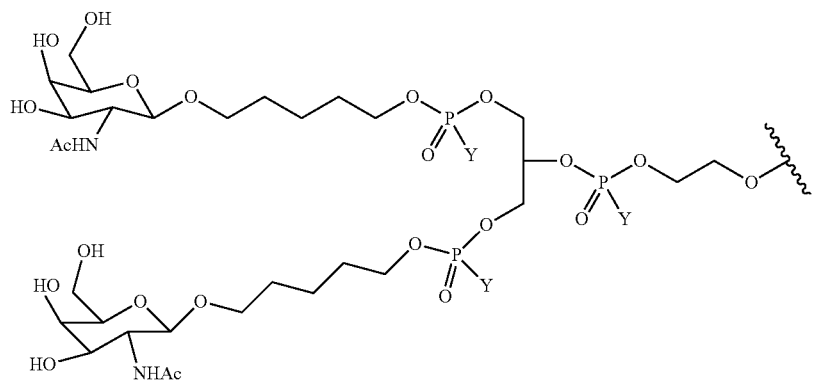

Example 112

Modified Oligonucleotides Comprising a GalNAc$_1$ Conjugate

The oligonucleotides in Table 120 targeting SRB-1 were synthesized with a GalNAc$_1$ conjugate group in order to further test the potency of oligonucleotides comprising conjugate groups that contain one GalNAc ligand.

TABLE 120

| ISIS No. | Sequence (5' to 3') | GalNAc cluster | CM | SEQ ID NO. |
|---|---|---|---|---|
| 711461 | GalNAc$_1$-25$_{a-o}$,A$_{do}$ G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-25$_a$ | A$_d$ | 2306 |
| 711462 | GalNAc$_1$-25$_{a-o}$,G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-25$_a$ | PO | 2304 |
| 711463 | GalNAc$_1$-25$_{a-o}$,G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_e$ | GalNAc$_1$-25$_a$ | PO | 2304 |
| 711465 | GalNAc$_1$-26$_{a-o}$,A$_{do}$ G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-26$_a$ | A$_d$ | 2306 |
| 711466 | GalNAc$_1$-26$_{a-o}$,G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-26$_a$ | PO | 2304 |
| 711467 | GalNAc$_1$-26$_{a-o}$,G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_e$ | GalNAc$_1$-26$_a$ | PO | 2304 |
| 711468 | GalNAc$_1$-28$_{a-o}$,A$_{do}$ G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-28$_a$ | A$_d$ | 2306 |
| 711469 | GalNAc$_1$-28$_{a-o}$,G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_e$ | GalNAc$_1$-28$_a$ | PO | 2304 |
| 711470 | GalNAc$_1$-28$_{a-o}$,G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_e$ | GalNAc$_1$-28$_a$ | PO | 2304 |
| 713844 | G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_{eo}$,-GalNAc$_1$-27$_a$ | GalNAc$_1$-27$_a$ | PO | 2304 |
| 713845 | G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_{eo}$,-GalNAc$_1$-27$_a$ | GalNAc$_1$-27$_a$ | PO | 2304 |
| 713846 | G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_{eo}$ A$_{do}$,-GalNAc$_1$-27$_a$ | GalNAc$_1$-27$_a$ | A$_d$ | 2305 |
| 713847 | G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_{eo}$,-GalNAc$_1$-29$_a$ | GalNAc$_1$-29$_a$ | PO | 2304 |
| 713848 | G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_{eo}$,-GalNAc$_1$-29$_a$ | GalNAc$_1$-29$_a$ | PO | 2304 |
| 713849 | G$_{es}$ $^m$C$_{es}$ T$_{es}$ T$_{es}$ $^m$C$_{es}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{es}$ $^m$C$_{es}$ $^m$C$_{es}$ T$_{es}$ T$_{eo}$ A$_{do}$,-GalNAc$_1$-29$_a$ | GalNAc$_1$-29$_a$ | A$_d$ | 2305 |
| 713850 | G$_{es}$ $^m$C$_{eo}$ T$_{eo}$ T$_{eo}$ $^m$C$_{eo}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{eo}$ $^m$C$_{eo}$ $^m$C$_{es}$ T$_{es}$ T$_{eo}$ A$_{do}$,-GalNAc$_1$-29$_a$ | GalNAc$_1$-29$_a$ | A$_d$ | 2305 |

Example 113

Antisense Oligonucleotides Targeting Growth Hormone Receptor and Comprising a GalNAc Cluster The oligonucleotides in Table 121 were designed to target human growth hormone receptor (GHR).

TABLE 121

| Sequences (5' to 3') | SEQ ID No. |
|---|---|
| GalNAc$_3$-3-$^m$C$_{es}$$^m$C$_{es}$A$_{es}$$^m$C$_{es}$$^m$C$_{es}$T$_{ds}$T$_{ds}$T$_{ds}$G$_{ds}$G$_{ds}$G$_{ds}$T$_{ds}$G$_{ds}$A$_{ds}$A$_{ds}$T$_{es}$A$_{es}$G$_{es}$$^m$C$_{es}$A$_e$ | 703 |
| GalNAc$_3$-3-$^m$C$_{es}$$^c$C$_{eo}$A$_{eo}$$^m$C$_{eo}$$^m$C$_{eo}$T$_{ds}$T$_{ds}$T$_{ds}$G$_{ds}$G$_{ds}$G$_{ds}$T$_{ds}$G$_{ds}$A$_{ds}$A$_{ds}$T$_{eo}$A$_{eo}$G$_{es}$$^m$C$_{es}$A$_e$ | 703 |
| GalNAc$_3$-7-$^m$C$_{es}$$^m$C$_{es}$A$_{es}$$^m$C$_{es}$$^m$C$_{es}$T$_{ds}$T$_{ds}$T$_{ds}$G$_{ds}$G$_{ds}$G$_{ds}$T$_{ds}$G$_{ds}$A$_{ds}$A$_{ds}$T$_{es}$A$_{es}$G$_{es}$$^m$C$_{es}$A$_e$ | 703 |
| GalNAc$_3$-7-$^m$C$_{es}$$^m$C$_{eo}$A$_{eo}$$^m$C$_{eo}$$^m$C$_{eo}$T$_{ds}$T$_{ds}$T$_{ds}$G$_{ds}$G$_{ds}$G$_{ds}$T$_{ds}$G$_{ds}$A$_{ds}$A$_{ds}$T$_{eo}$A$_{eo}$G$_{es}$$^m$C$_{es}$A$_e$ | 703 |
| GalNAc$_3$-10-$^m$C$_{es}$$^m$C$_{es}$A$_{es}$$^m$C$_{es}$$^m$C$_{es}$T$_{ds}$T$_{ds}$T$_{ds}$G$_{ds}$G$_{ds}$G$_{ds}$T$_{ds}$G$_{ds}$A$_{ds}$A$_{ds}$T$_{es}$A$_{es}$G$_{es}$$^m$C$_{es}$A$_e$ | 703 |
| GalNAc$_3$-10-$^m$C$_{es}$$^m$C$_{eo}$A$_{eo}$$^m$C$_{eo}$$^m$C$_{eo}$T$_{ds}$T$_{ds}$T$_{ds}$G$_{ds}$G$_{ds}$G$_{ds}$T$_{ds}$G$_{ds}$A$_{ds}$A$_{ds}$T$_{eo}$A$_{eo}$G$_{es}$$^m$C$_{es}$A$_e$ | 703 |
| GalNAc$_3$-13-$^m$C$_{es}$$^m$C$_{es}$A$_{es}$$^m$C$_{es}$$^m$C$_{es}$T$_{ds}$T$_{ds}$T$_{ds}$G$_{ds}$G$_{ds}$G$_{ds}$T$_{ds}$G$_{ds}$A$_{ds}$A$_{ds}$T$_{es}$A$_{es}$G$_{es}$$^m$C$_{es}$A$_e$ | 703 |
| GalNAc$_3$-13-$^m$C$_{es}$$^m$C$_{eo}$A$_{eo}$$^m$C$_{eo}$$^m$C$_{eo}$T$_{ds}$T$_{ds}$T$_{ds}$G$_{ds}$G$_{ds}$G$_{ds}$T$_{ds}$G$_{ds}$A$_{ds}$A$_{ds}$T$_{eo}$A$_{eo}$G$_{es}$$^m$C$_{es}$A$_e$ | 703 |
| $^m$C$_{es}$$^m$C$_{es}$A$_{es}$$^m$C$_{es}$$^m$C$_{es}$T$_{ds}$T$_{ds}$T$_{ds}$G$_{ds}$G$_{ds}$G$_{ds}$T$_{ds}$G$_{ds}$A$_{ds}$A$_{ds}$T$_{es}$A$_{es}$G$_{es}$$^m$C$_{es}$A$_e$-GalNAc$_3$-19 | 703 |
| $^m$C$_{es}$$^m$C$_{eo}$A$_{eo}$$^m$C$_{eo}$$^m$C$_{eo}$T$_{ds}$T$_{ds}$T$_{ds}$G$_{ds}$G$_{ds}$G$_{ds}$T$_{ds}$G$_{ds}$A$_{ds}$A$_{ds}$T$_{eo}$A$_{eo}$G$_{es}$$^m$C$_{es}$A$_e$-GalNAc$_3$-19 | 703 |

Example 114

Antisense Inhibition of Human Growth Hormone Receptor in Hep3B Cells by MOE Gapmers Antisense oligonucleotides were designed targeting a growth hormone receptor (GHR) nucleic acid and were tested for their effects on GHR mRNA in vitro. The antisense oligonucleotides were tested in a series of experiments that had similar culture conditions. The results for each experiment are presented in separate tables shown below. Cultured Hep3B cells at a density of 20,000 cells per well were transfected using electroporation with 4,500 nM antisense oligonucleotide. After a treatment period of approximately 24 hours, RNA was isolated from the cells and GHR mRNA levels were measured by quantitative real-time PCR. Human primer probe set RTS3437_MGB (forward sequence CGAGTTCAGTGAGGTGCTCTATGT, designated herein as SEQ ID NO: 2329; reverse sequence AAGAGCCATG-GAAAGTAGAAATCTTC, designated herein as SEQ ID NO: 2330; probe sequence TTCCTCAGATGAGCCAATT, designated herein as SEQ ID NO: 2331) was used to measure mRNA levels. GHR mRNA levels were adjusted according to total RNA content, as measured by RIBOGREEN®. Results are presented as percent inhibition of GHR, relative to untreated control cells.

The newly designed chimeric antisense oligonucleotides in the Tables below were designed as 5-10-5 MOE or 3-10-4 MOE gapmers. The 5-10-5 MOE gapmers are 20 nucleosides in length, wherein the central gap segment comprises of ten 2'-deoxynucleosides and is flanked by wing segments on the 5' direction and the 3' direction comprising five nucleosides each. The 3-10-4 MOE gapmers are 17 nucleosides in length, wherein the central gap segment comprises of ten 2'-deoxynucleosides and is flanked by wing segments on the 5' direction and the 3' direction comprising three and four nucleosides respectively. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human GHR mRNA, designated herein as SEQ ID NO: 1 (GENBANK Accession No. NM_000163.4) or the human GHR genomic sequence, designated herein as SEQ ID NO: 2 (GENBANK Accession No. NT_006576.16 truncated from nucleotides 42411001 to 42714000). 'n/a' indicates that the antisense oligonucleotide does not target that particular gene sequence with 100% complementarity. In case the sequence alignment for a target gene in a particular table is not shown, it is understood that none of the oligonucleotides presented in that table align with 100% complementarity with that target gene.

TABLE 122

Inhibition of GHR mRNA by 5-10-5 MOE gapmers targeting exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 523266 | 164 | 183 | Exon 1 | ACCTCCGAGCTTCGCCTCTG | 64 | 3040 | 3059 | 20 |
| 523267 | 171 | 190 | Exon-exon junction | CTGTAGGACCTCCGAGCTTC | 31 | n/a | n/a | 21 |
| 523268 | 178 | 197 | Exon-exon junction | TCCATACCTGTAGGACCTCC | 37 | n/a | n/a | 22 |
| 523271 | 206 | 225 | Exon 2 | TGCCAAGGTCAACAGCAGCT | 80 | 144990 | 145009 | 23 |
| 523272 | 213 | 232 | Exon 2 | CTGCCAGTGCCAAGGTCAAC | 53 | 144997 | 145016 | 24 |
| 523273 | 220 | 239 | Exon 2 | CTTGATCCTGCCAGTGCCAA | 49 | 145004 | 145023 | 25 |
| 523274 | 227 | 246 | Exon 2 | AGCATCACTTGATCCTGCCA | 67 | 145011 | 145030 | 26 |
| 523275 | 234 | 253 | Exon 2 | CAGAAAAGCATCACTTGAT | 0 | 145018 | 145037 | 27 |
| 523276 | 241 | 260 | Exon 2 | TCACTTCCAGAAAAGCATC | 1 | 145025 | 145044 | 28 |
| 523284 | 361 | 380 | Exon 4 | GTCTCTCGCTCAGGTGAACG | 48 | 268024 | 268043 | 29 |
| 523285 | 368 | 387 | Exon 4 | TGAAAAGTCTCTCGCTCAG | 15 | 268031 | 268050 | 30 |
| 523286 | 375 | 394 | Exon 4 | AGTGGCATGAAAAGTCTCT | 14 | 268038 | 268057 | 31 |
| 523287 | 382 | 401 | Exon 4 | TCTGTCCAGTGGCATGAAAA | 4 | 268045 | 268064 | 32 |
| 523301 | 625 | 644 | Exon 6 | GGATCTGGTTGCACTATTTC | 36 | n/a | n/a | 33 |
| 523302 | 632 | 651 | Exon 6 | AATGGGTGGATCTGGTTGCA | 28 | 278926 | 278945 | 34 |
| 523303 | 647 | 666 | Exon 6 | AGTCCAGTTGAGGGCAATGG | 26 | 278941 | 278960 | 35 |
| 523304 | 654 | 673 | Exon 6 | TCAGTAAAGTCCAGTTGAGG | 0 | 278948 | 278967 | 36 |
| 523305 | 675 | 694 | Exon 6 | GAATCCCAGTTAAACTGACG | 19 | 278969 | 278988 | 37 |
| 523306 | 682 | 701 | Exon 6 | TCTGCATGAATCCCAGTTAA | 39 | 278976 | 278995 | 38 |
| 523309 | 736 | 755 | Exon 6 | ATCCATCCTTTCTGAATATC | 34 | 279030 | 279049 | 39 |
| 523310 | 743 | 762 | Exon 6 | CAGAACCATCCATCCTTTCT | 31 | 279037 | 279056 | 40 |
| 523311 | 750 | 769 | Exon 6 | CATACTCCAGAACCATCCAT | 44 | 279044 | 279063 | 41 |
| 523312 | 757 | 776 | Exon 6 | TGAAGTTCATACTCCAGAAC | 23 | 279051 | 279070 | 42 |
| 523313 | 764 | 783 | Exon 6 | TTTGTATTGAAGTTCATACT | 6 | 279058 | 279077 | 43 |
| 523314 | 771 | 790 | Exon 6 | TTACTTCTTTGTATTGAAGT | 0 | 279065 | 279084 | 44 |
| 523315 | 778 | 797 | Exon 6 | GTTTCATTTACTTCTTTGTA | 3 | 279072 | 279091 | 45 |
| 523316 | 785 | 804 | Exon 6 | CCATTTAGTTTCATTTACTT | 0 | 279079 | 279098 | 46 |
| 523317 | 792 | 811 | Exon 4-exon 5 junction | TCATTTTCCATTTAGTTTCA | 19 | n/a | n/a | 47 |
| 523323 | 862 | 881 | Exon 7 | ACACGCACTTCATATTCCTT | 63 | 290360 | 290379 | 48 |
| 523324 | 869 | 888 | Exon 7 | GGATCTCACACGCACTTCAT | 80 | 290367 | 290386 | 49 |
| 523328 | 926 | 945 | Exon 7 | AAGTGTTACATAGAGCACCT | 56 | 290424 | 290443 | 50 |
| 523329 | 933 | 952 | Exon 7 | TCTGAGGAAGTGTTACATAG | 53 | 290431 | 290450 | 51 |
| 523330 | 957 | 976 | Exon 7 | CTTCTTCACATGTAAATTGG | 32 | 290455 | 290474 | 52 |

TABLE 122-continued

Inhibition of GHR mRNA by 5-10-5 MOE gapmers targeting exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 523331 | 964 | 983 | Exon 5-exon 6 junction | TAGAAATCTTCTTCACATGT | 4 | n/a | n/a | 53 |
| 523332 | 971 | 990 | Exon 5-exon 6 junction | TGGAAAGTAGAAATCTTCTT | 9 | n/a | n/a | 54 |
| 523333 | 978 | 997 | Exon 8 | AGAGCCATGGAAAGTAGAAA | 46 | 292532 | 292551 | 55 |
| 523334 | 985 | 1004 | Exon 8 | ATAATTAAGAGCCATGGAAA | 0 | 292539 | 292558 | 56 |

TABLE 123

Inhibition of GHR mRNA by 5-10-5 MOE gapmers targeting exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 523421 | 2072 | 2091 | exon 10 | CAGTTGGTCTGTGCTCACAT | 76 | 298489 | 298508 | 57 |
| 533002 | 207 | 226 | exon 2 | GTGCCAAGGTCAACAGCAGC | 63 | 144991 | 145010 | 58 |
| 533003 | 208 | 227 | exon 2 | AGTGCCAAGGTCAACAGCAG | 62 | 144992 | 145011 | 59 |
| 533004 | 225 | 244 | exon 2 | CATCACTTGATCCTGCCAGT | 53 | 145009 | 145028 | 60 |
| 533005 | 226 | 245 | exon 2 | GCATCACTTGATCCTGCCAG | 80 | 145010 | 145029 | 61 |
| 533006 | 228 | 247 | exon 2 | AAGCATCACTTGATCCTGCC | 75 | 145012 | 145031 | 62 |
| 533007 | 229 | 248 | exon 2 | AAAGCATCACTTGATCCTGC | 61 | 145013 | 145032 | 63 |
| 533019 | 867 | 886 | exon 7 | ATCTCACACGCACTTCATAT | 35 | 290365 | 290384 | 64 |
| 533020 | 868 | 887 | exon 7 | GATCTCACACGCACTTCATA | 47 | 290366 | 290385 | 65 |
| 533021 | 870 | 889 | exon 7 | TGGATCTCACACGCACTTCA | 86 | 290368 | 290387 | 66 |
| 533022 | 871 | 890 | exon 7 | TTGGATCTCACACGCACTTC | 70 | 290369 | 290388 | 67 |
| 533037 | 1360 | 1379 | exon 10 | TCCAGAATGTCAGGTTCACA | 59 | 297777 | 297796 | 68 |
| 533038 | 1361 | 1380 | exon 10 | CTCCAGAATGTCAGGTTCAC | 74 | 297778 | 297797 | 69 |
| 533039 | 1363 | 1382 | exon 10 | GTCTCCAGAATGTCAGGTTC | 45 | 297780 | 297799 | 70 |
| 533040 | 1364 | 1383 | exon 10 | AGTCTCCAGAATGTCAGGTT | 51 | 297781 | 297800 | 71 |
| 533042 | 1525 | 1544 | exon 10 | GCTTGGATAACACTGGGCTG | 41 | 297942 | 297961 | 72 |
| 533043 | 1526 | 1545 | exon 10 | TGCTTGGATAACACTGGGCT | 46 | 297943 | 297962 | 73 |
| 533044 | 1528 | 1547 | exon 10 | TCTGCTTGGATAACACTGGG | 55 | 297945 | 297964 | 74 |
| 533045 | 1529 | 1548 | exon 10 | CTCTGCTTGGATAACACTGG | 47 | 297946 | 297965 | 75 |
| 533046 | 1530 | 1549 | exon 10 | TCTCTGCTTGGATAACACTG | 54 | 297947 | 297966 | 76 |
| 533047 | 1744 | 1763 | exon 10 | CAGAGTGAGACCATTTCCGG | 47 | 298161 | 298180 | 77 |
| 533048 | 1745 | 1764 | exon 10 | GCAGAGTGAGACCATTTCCG | 60 | 298162 | 298181 | 78 |
| 533049 | 1747 | 1766 | exon 10 | TGGCAGAGTGAGACCATTTC | 65 | 298164 | 298183 | 79 |

TABLE 123-continued

Inhibition of GHR mRNA by 5-10-5 MOE gapmers targeting exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 533050 | 1748 | 1767 | exon 10 | TTGGCAGAGTGAGACCATTT | 47 | 298165 | 298184 | 80 |
| 533051 | 1749 | 1768 | exon 10 | CTTGGCAGAGTGAGACCATT | 30 | 298166 | 298185 | 81 |
| 533066 | 2685 | 2704 | exon 10 | CAGTGTGTAGTGTAATATAA | 53 | 299102 | 299121 | 82 |
| 533067 | 2686 | 2705 | exon 10 | ACAGTGTGTAGTGTAATATA | 68 | 299103 | 299122 | 83 |
| 533068 | 2688 | 2707 | exon 10 | ACACAGTGTGTAGTGTAATA | 62 | 299105 | 299124 | 84 |
| 533069 | 2689 | 2708 | exon 10 | TACACAGTGTGTAGTGTAAT | 55 | 299106 | 299125 | 85 |
| 533070 | 2690 | 2709 | exon 10 | GTACACAGTGTGTAGTGTAA | 50 | 299107 | 299126 | 86 |
| 533071 | 3205 | 3224 | exon 10 | TGTACCTTATTCCCTTCCTG | 68 | 299622 | 299641 | 87 |
| 533072 | 3206 | 3225 | exon 10 | TTGTACCTTATTCCCTTCCT | 61 | 299623 | 299642 | 88 |
| 533073 | 3208 | 3227 | exon 10 | TCTTGTACCTTATTCCCTTC | 60 | 299625 | 299644 | 89 |
| 533074 | 3209 | 3228 | exon 10 | TTCTTGTACCTTATTCCCTT | 46 | 299626 | 299645 | 90 |

TABLE 124

Inhibition of GHR mRNA by 5-10-5 MOE gapmers targeting intronic and exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 532174 | n/a | n/a | Intron 1 | ACATGTACCCAAACCAACAC | 37 | 18731 | 18750 | 91 |
| 533086 | 3210 | 3229 | Exon 10 | CTTCTTGTACCTTATTCCCT | 72 | 299627 | 299646 | 92 |
| 533087 | 3212 | 3231 | Exon 10 | TGCTTCTTGTACCTTATTCC | 77 | 299629 | 299648 | 93 |
| 533088 | 3213 | 3232 | Exon 10 | ATGCTTCTTGTACCTTATTC | 63 | 299630 | 299649 | 94 |
| 533089 | 3215 | 3234 | Exon 10 | AAATGCTTCTTGTACCTTAT | 67 | 299632 | 299651 | 95 |
| 533090 | 3216 | 3235 | Exon 10 | AAAATGCTTCTTGTACCTTA | 50 | 299633 | 299652 | 96 |
| 533091 | 3217 | 3236 | Exon 10 | CAAAATGCTTCTTGTACCTT | 44 | 299634 | 299653 | 97 |
| 533092 | 3518 | 3537 | Exon 10 | CTTCTGAATGCTTGCTTTGA | 29 | 299935 | 299954 | 98 |
| 533093 | 3519 | 3538 | Exon 10 | TCTTCTGAATGCTTGCTTTG | 47 | 299936 | 299955 | 99 |
| 533094 | 3521 | 3540 | Exon 10 | TTTCTTCTGAATGCTTGCTT | 63 | 299938 | 299957 | 100 |
| 533095 | 3522 | 3541 | Exon 10 | TTTTCTTCTGAATGCTTGCT | 51 | 299939 | 299958 | 101 |
| 533096 | 3523 | 3542 | Exon 10 | TTTTTCTTCTGAATGCTTGC | 34 | 299940 | 299959 | 102 |
| 533097 | 4041 | 4060 | Exon 10 | TGCGATAAATGGGAAATACT | 36 | 300458 | 300477 | 103 |
| 533098 | 4042 | 4061 | Exon 10 | CTGCGATAAATGGGAAATAC | 52 | 300459 | 300478 | 104 |
| 533099 | 4043 | 4062 | Exon 10 | TCTGCGATAAATGGGAAATA | 41 | 300460 | 300479 | 105 |
| 533100 | 4045 | 4064 | Exon 10 | GGTCTGCGATAAATGGGAAA | 40 | 300462 | 300481 | 106 |
| 533101 | 4046 | 4065 | Exon 10 | AGGTCTGCGATAAATGGGAA | 39 | 300463 | 300482 | 107 |
| 533102 | 4048 | 4067 | Exon 10 | AAAGGTCTGCGATAAATGGG | 34 | 300465 | 300484 | 108 |

TABLE 124-continued

Inhibition of GHR mRNA by 5-10-5 MOE gapmers targeting intronic and exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 533103 | 4049 | 4068 | Exon 10 | AAAAGGTCTGCGATAAATGG | 35 | 300466 | 300485 | 109 |
| 533104 | 4050 | 4069 | Exon 10 | AAAAAGGTCTGCGATAAATG | 15 | 300467 | 300486 | 110 |
| 533115 | n/a | n/a | Intron 1 | CATGAAGGCCACTCTTCCAA | 63 | 12777 | 12796 | 111 |
| 533116 | n/a | n/a | Intron 1 | CCATGAAGGCCACTCTTCCA | 78 | 12778 | 12797 | 112 |
| 533117 | n/a | n/a | Intron 1 | CCCATGAAGGCCACTCTTCC | 71 | 12779 | 12798 | 113 |
| 533118 | n/a | n/a | Intron 1 | TGCCCATGAAGGCCACTCTT | 66 | 12781 | 12800 | 114 |
| 533119 | n/a | n/a | Intron 1 | TTGCCCATGAAGGCCACTCT | 60 | 12782 | 12801 | 115 |
| 533120 | n/a | n/a | Intron 1 | GTTGCCCATGAAGGCCACTC | 74 | 12783 | 12802 | 116 |
| 533121 | n/a | n/a | Intron 1 | GGTCTTTCATGAATCAAGCT | 79 | 17927 | 17946 | 117 |
| 533122 | n/a | n/a | Intron 1 | TGGTCTTTCATGAATCAAGC | 83 | 17928 | 17947 | 118 |
| 533123 | n/a | n/a | Intron 1 | ATGGTCTTTCATGAATCAAG | 83 | 17929 | 17948 | 119 |
| 533124 | n/a | n/a | Intron 1 | TGATGGTCTTTCATGAATCA | 78 | 17931 | 17950 | 120 |
| 533125 | n/a | n/a | Intron 1 | CTGATGGTCTTTCATGAATC | 82 | 17932 | 17951 | 121 |
| 533126 | n/a | n/a | Intron 1 | GCTGATGGTCTTTCATGAAT | 74 | 17933 | 17952 | 122 |
| 533127 | n/a | n/a | Intron 1 | GTACCCAAACCAACACTAAT | 57 | 18727 | 18746 | 123 |
| 533128 | n/a | n/a | Intron 1 | TGTACCCAAACCAACACTAA | 65 | 18728 | 18747 | 124 |
| 533129 | n/a | n/a | Intron 1 | ATGTACCCAAACCAACACTA | 64 | 18729 | 18748 | 125 |
| 533130 | n/a | n/a | Intron 1 | GACATGTACCCAAACCAACA | 63 | 18732 | 18751 | 126 |
| 533131 | n/a | n/a | Intron 1 | AGACATGTACCCAAACCAAC | 81 | 18733 | 18752 | 127 |
| 533132 | n/a | n/a | Intron 1 | AGGAATGGAAAACCAAATAT | 49 | 26494 | 26513 | 128 |
| 533133 | n/a | n/a | Intron 1 | CAGGAATGGAAAACCAAATA | 74 | 26495<br>121986 | 26514<br>122005 | 129 |
| 533134 | n/a | n/a | Intron 1 | TCAGGAATGGAAAACCAAAT | 73 | 26496<br>121987 | 26515<br>122006 | 130 |
| 533135 | n/a | n/a | Intron 1 | ACTCAGGAATGGAAAACCAA | 77 | 26498<br>113032<br>121989 | 26517<br>113051<br>122008 | 131 |
| 533136 | n/a | n/a | Intron 1 | AACTCAGGAATGGAAAACCA | 79 | 26499<br>113033<br>121990 | 26518<br>113052<br>122009 | 132 |
| 533137 | n/a | n/a | Intron 1 | TAACTCAGGAATGGAAAACC | 67 | 26500<br>113034<br>121991 | 26519<br>113053<br>122010 | 133 |
| 533138 | n/a | n/a | Intron 1 | CAAAATTACTGCAGTCACAG | 67 | 39716 | 39735 | 134 |
| 533139 | n/a | n/a | Intron 1 | ACAAAATTACTGCAGTCACA | 81 | 39717 | 39736 | 135 |
| 533140 | n/a | n/a | Intron 1 | TACAAAATTACTGCAGTCAC | 81 | 39718 | 39737 | 136 |
| 533141 | n/a | n/a | Intron 1 | CATACAAAATTACTGCAGTC | 67 | 39720 | 39739 | 137 |
| 533142 | n/a | n/a | Intron 1 | ACATACAAAATTACTGCAGT | 48 | 39721 | 39740 | 138 |
| 533143 | n/a | n/a | Intron 1 | AACATACAAAATTACTGCAG | 53 | 39722 | 39741 | 139 |

TABLE 124-continued

Inhibition of GHR mRNA by 5-10-5 MOE gapmers targeting intronic and exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 533144 | n/a | n/a | Intron 1 | TTTTAGTATGAACCTTAAAA | 0 | 42139 | 42158 | 140 |
| 533145 | n/a | n/a | Intron 1 | CTTTTAGTATGAACCTTAAA | 38 | 42140 | 42159 | 141 |
| 533146 | n/a | n/a | Intron 1 | TCTTTTAGTATGAACCTTAA | 57 | 42141 | 42160 | 142 |
| 533147 | n/a | n/a | Intron 1 | AATCTTTTAGTATGAACCTT | 60 | 42143 | 42162 | 143 |
| 533148 | n/a | n/a | Intron 1 | CAATCTTTTAGTATGAACCT | 70 | 42144 | 42163 | 144 |
| 533149 | n/a | n/a | Intron 1 | ACAATCTTTTAGTATGAACC | 60 | 42145 | 42164 | 145 |
| 533150 | n/a | n/a | Intron 1 | AAGTTATGTGACTCTGAGCA | 67 | 43174 | 43193 | 146 |
| 533151 | n/a | n/a | Intron 1 | CAAGTTATGTGACTCTGAGC | 67 | 43175 | 43194 | 147 |
| 533152 | n/a | n/a | Intron 1 | TCAAGTTATGTGACTCTGAG | 63 | 43176 | 43195 | 148 |
| 533153 | n/a | n/a | Intron 1 | AGTTCTCCATTAGGGTTCTG | 83 | 50948 | 50967 | 149 |
| 533154 | n/a | n/a | Intron 1 | TAGTTCTCCATTAGGGTTCT | 76 | 50949 | 50968 | 150 |
| 533155 | n/a | n/a | Intron 1 | ATAGTTCTCCATTAGGGTTC | 51 | 50950 | 50969 | 151 |
| 533156 | n/a | n/a | Intron 1 | AAGCAGGTTGGCAGACAGAC | 79 | 53467 | 53486 | 152 |
| 533157 | n/a | n/a | Intron 1 | GAAGCAGGTTGGCAGACAGA | 60 | 53468 | 53487 | 153 |
| 533158 | n/a | n/a | Intron 1 | GGAAGCAGGTTGGCAGACAG | 67 | 53469 | 53488 | 154 |
| 533159 | n/a | n/a | Intron 1 | TCTTCTTGTGAGCTGGCTTC | 61 | 64882 | 64901 | 155 |
| 533160 | n/a | n/a | Intron 1 | GTCTTCTTGTGAGCTGGCTT | 83 | 64883 | 64902 | 156 |
| 533161 | n/a | n/a | Intron 1 | AGTCTTCTTGTGAGCTGGCT | 81 | 64884 | 64903 | 157 |

TABLE 125

Inhibition of GHR mRNA by 5-10-5 MOE gapmers targeting intronic and exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 533133 | n/a | n/a | Intron 1 | CAGGAATGGAAAACCAAATA | 76 | 26495 121986 | 26514 122005 | 129 |
| 533134 | n/a | n/a | Intron 1 | TCAGGAATGGAAAACCAAAT | 83 | 26496 121987 | 26515 122006 | 130 |
| 533174 | n/a | n/a | Intron 1 | TAAGTCTTCTTGTGAGCTGG | 73 | 64886 | 64905 | 158 |
| 533175 | n/a | n/a | Intron 1 | TTAAGTCTTCTTGTGAGCTG | 58 | 64887 | 64906 | 159 |
| 533176 | n/a | n/a | Intron 1 | ATTAAGTCTTCTTGTGAGCT | 51 | 64888 | 64907 | 160 |
| 533177 | n/a | n/a | Intron 1 | TCTCTTCCACTCACATCCAT | 72 | 65989 | 66008 | 161 |
| 533178 | n/a | n/a | Intron 1 | GTCTCTTCCACTCACATCCA | 86 | 65990 | 66009 | 162 |
| 533179 | n/a | n/a | Intron 1 | AGTCTCTTCCACTCACATCC | 80 | 65991 | 66010 | 163 |
| 533180 | n/a | n/a | Intron 1 | TAAGTATTTGTAGCAGTTGC | 31 | 78195 | 78214 | 164 |
| 533181 | n/a | n/a | Intron 1 | CTAAGTATTTGTAGCAGTTG | 14 | 78196 | 78215 | 165 |

TABLE 125-continued

Inhibition of GHR mRNA by 5-10-5 MOE gapmers targeting intronic and exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 533182 | n/a | n/a | Intron 1 | GCTAAGTATTTGTAGCAGTT | 59 | 78197 | 78216 | 166 |
| 533183 | n/a | n/a | Intron 1 | TGGCTAAGTATTTGTAGCAG | 34 | 78199 | 78218 | 167 |
| 533184 | n/a | n/a | Intron 1 | TTGGCTAAGTATTTGTAGCA | 18 | 78200 | 78219 | 168 |
| 533185 | n/a | n/a | Intron 1 | TTTGGCTAAGTATTTGTAGC | 21 | 78201 | 78220 | 169 |
| 533186 | n/a | n/a | Intron 1 | AAAATGTCAACAGTGCATAG | 61 | 80636 | 80655 | 170 |
| 533187 | n/a | n/a | Intron 1 | CAAAATGTCAACAGTGCATA | 78 | 80637 | 80656 | 171 |
| 533188 | n/a | n/a | Intron 1 | CCAAAATGTCAACAGTGCAT | 85 | 80638 | 80657 | 172 |
| 533189 | n/a | n/a | Intron 1 | GCCCAAAATGTCAACAGTGC | 82 | 80640 | 80659 | 173 |
| 533190 | n/a | n/a | Intron 1 | GGCCCAAAATGTCAACAGTG | 60 | 80641 | 80660 | 174 |
| 533191 | n/a | n/a | Intron 1 | TGGCCCAAAATGTCAACAGT | 31 | 80642 | 80661 | 175 |
| 533192 | n/a | n/a | Intron 1 | CAGAATCTTCTCTTTGGCCA | 66 | 98624 | 98643 | 176 |
| 533193 | n/a | n/a | Intron 1 | GCAGAATCTTCTCTTTGGCC | 81 | 98625 | 98644 | 177 |
| 533194 | n/a | n/a | Intron 1 | TGCAGAATCTTCTCTTTGGC | 72 | 98626 | 98645 | 178 |
| 533195 | n/a | n/a | Intron 1 | TTTGCAGAATCTTCTCTTTG | 33 | 98628 | 98647 | 179 |
| 533196 | n/a | n/a | Intron 1 | ATTTGCAGAATCTTCTCTTT | 27 | 98629 | 98648 | 180 |
| 533197 | n/a | n/a | Intron 1 | AATTTGCAGAATCTTCTCTT | 38 | 98630 | 98649 | 181 |
| 533198 | n/a | n/a | Intron 1 | ATAAAGCTATGCCATAAAGC | 37 | 99478 | 99497 | 182 |
| 533199 | n/a | n/a | Intron 1 | CATAAAGCTATGCCATAAAG | 14 | 99479 | 99498 | 183 |
| 533200 | n/a | n/a | Intron 1 | CCATAAAGCTATGCCATAAA | 30 | 99480 | 99499 | 184 |
| 533201 | n/a | n/a | Intron 1 | GACCATAAAGCTATGCCATA | 54 | 99482 | 99501 | 185 |
| 533202 | n/a | n/a | Intron 1 | TGACCATAAAGCTATGCCAT | 64 | 99483 | 99502 | 186 |
| 533203 | n/a | n/a | Intron 1 | CTGACCATAAAGCTATGCCA | 61 | 99484 | 99503 | 187 |
| 533204 | n/a | n/a | Intron 1 | CAAAAAGTTGAGCTGAGAAA | 0 | 101078 | 101097 | 188 |
| 533205 | n/a | n/a | Intron 1 | CCAAAAAGTTGAGCTGAGAA | 28 | 101079 | 101098 | 189 |
| 533206 | n/a | n/a | Intron 1 | CCCAAAAAGTTGAGCTGAGA | 52 | 101080 | 101099 | 190 |
| 533207 | n/a | n/a | Intron 1 | CACCCAAAAAGTTGAGCTGA | 60 | 101082 | 101101 | 191 |
| 533208 | n/a | n/a | Intron 1 | ACACCCAAAAAGTTGAGCTG | 34 | 101083 | 101102 | 192 |
| 533209 | n/a | n/a | Intron 1 | TACACCCAAAAAGTTGAGCT | 36 | 101084 | 101103 | 193 |
| 533210 | n/a | n/a | Intron 1 | CTTTTAATGGCACCCAAGCA | 41 | 103566 | 103585 | 194 |
| 533211 | n/a | n/a | Intron 1 | GCTTTTAATGGCACCCAAGC | 54 | 103567 | 103586 | 195 |
| 533212 | n/a | n/a | Intron 1 | TGCTTTTAATGGCACCCAAG | 67 | 103568 | 103587 | 196 |
| 533213 | n/a | n/a | Intron 1 | AATGCTTTTAATGGCACCCA | 73 | 103570 | 103589 | 197 |
| 533214 | n/a | n/a | Intron 1 | AAATGCTTTTAATGGCACCC | 73 | 103571 | 103590 | 198 |
| 533215 | n/a | n/a | Intron 1 | GAAATGCTTTTAATGGCACC | 41 | 103572 | 103591 | 199 |
| 533216 | n/a | n/a | Intron 1 | TAATTCTTAAGGGCCCTCTG | 36 | 106963 | 106982 | 200 |

TABLE 125-continued

Inhibition of GHR mRNA by 5-10-5 MOE gapmers targeting intronic and exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 533217 | n/a | n/a | Intron 1 | ATAATTCTTAAGGGCCCTCT | 45 | 106964 | 106983 | 201 |
| 533218 | n/a | n/a | Intron 1 | CATAATTCTTAAGGGCCCTC | 50 | 106965 | 106984 | 202 |
| 533219 | n/a | n/a | Intron 1 | AGCATAATTCTTAAGGGCCC | 48 | 106967 | 106986 | 203 |
| 533220 | n/a | n/a | Intron 1 | TAGCATAATTCTTAAGGGCC | 52 | 106968 | 106987 | 204 |
| 533221 | n/a | n/a | Intron 1 | TTAGCATAATTCTTAAGGGC | 28 | 106969 | 106988 | 205 |
| 533222 | n/a | n/a | Intron 1 | AGGAATGGAAAACCAAACAT | 13 | 113028 | 113047 | 206 |
| 533223 | n/a | n/a | Intron 1 | CAGGAATGGAAAACCAAACA | 64 | 113029 | 113048 | 207 |
| 533224 | n/a | n/a | Intron 1 | TCAGGAATGGAAAACCAAAC | 61 | 113030 | 113049 | 208 |
| 533225 | n/a | n/a | Intron 1 | AGGAATGGAAAACCAAATAC | 18 | 121985 | 122004 | 209 |
| 533226 | n/a | n/a | Intron 1 | CATGACTATGTTCTGGCAAG | 37 | 125591 | 125610 | 210 |
| 533227 | n/a | n/a | Intron 1 | ACATGACTATGTTCTGGCAA | 44 | 125592 | 125611 | 211 |
| 533228 | n/a | n/a | Intron 1 | CACATGACTATGTTCTGGCA | 63 | 125593 | 125612 | 212 |
| 533229 | n/a | n/a | Intron 1 | GTCACATGACTATGTTCTGG | 47 | 125595 | 125614 | 213 |
| 533230 | n/a | n/a | Intron 1 | GGTCACATGACTATGTTCTG | 49 | 125596 | 125615 | 214 |
| 533231 | n/a | n/a | Intron 1 | TGGTCACATGACTATGTTCT | 30 | 125597 | 125616 | 215 |
| 533232 | n/a | n/a | Intron 2 | CTGAATTCTGAGCTCTGGAA | 73 | 145428 | 145447 | 216 |
| 533233 | n/a | n/a | Intron 2 | CCTGAATTCTGAGCTCTGGA | 88 | 145429 | 145448 | 217 |
| 533234 | n/a | n/a | Intron 2 | GCCTGAATTCTGAGCTCTGG | 92 | 145430 | 145449 | 218 |
| 533235 | n/a | n/a | Intron 2 | AAGCCTGAATTCTGAGCTCT | 83 | 145432 | 145451 | 219 |
| 533236 | n/a | n/a | Intron 2 | CAAGCCTGAATTCTGAGCTC | 68 | 145433 | 145452 | 220 |
| 533237 | n/a | n/a | Intron 2 | ACAAGCCTGAATTCTGAGCT | 81 | 145434 | 145453 | 221 |
| 533238 | n/a | n/a | Intron 2 | GGATCTCAGCTGCAATTCTT | 72 | 146235 | 146254 | 222 |
| 533239 | n/a | n/a | Intron 2 | AGGATCTCAGCTGCAATTCT | 53 | 146236 | 146255 | 223 |
| 533240 | n/a | n/a | Intron 2 | GAGGATCTCAGCTGCAATTC | 69 | 146237 | 146256 | 224 |
| 533241 | n/a | n/a | Intron 2 | CAGAGGATCTCAGCTGCAAT | 69 | 146239 | 146258 | 225 |
| 533242 | n/a | n/a | Intron 2 | GCAGAGGATCTCAGCTGCAA | 76 | 146240 | 146259 | 226 |
| 533243 | 230 | 249 | Exon 2 | AAAAGCATCACTTGATCCTG | 23 | 145014 | 145033 | 227 |

TABLE 126

Inhibition of GHR mRNA by 3-10-4 MOE gapmers targeting intronic and exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 539284 | 206 | 222 | Exon 2 | CAAGGTCAACAGCAGCT | 62 | 144990 | 145006 | 228 |
| 539285 | 207 | 223 | Exon 2 | CCAAGGTCAACAGCAGC | 74 | 144991 | 145007 | 229 |

TABLE 126-continued

Inhibition of GHR mRNA by 3-10-4 MOE gapmers targeting intronic and exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 539286 | 208 | 224 | Exon 2 | GCCAAGGTCAACAGCAG | 73 | 144992 | 145008 | 230 |
| 539290 | 869 | 885 | Exon 7 | TCTCACACGCACTTCAT | 29 | 290367 | 290383 | 231 |
| 539291 | 870 | 886 | Exon 7 | ATCTCACACGCACTTCA | 51 | 290368 | 290384 | 232 |
| 539292 | 871 | 887 | Exon 7 | GATCTCACACGCACTTC | 56 | 290369 | 290385 | 233 |
| 539299 | n/a | n/a | Intron 1 | CTTTCATGAATCAAGCT | 63 | 17927 | 17943 | 234 |
| 539300 | n/a | n/a | Intron 1 | TCTTTCATGAATCAAGC | 49 | 17928 | 17944 | 235 |
| 539301 | n/a | n/a | Intron 1 | GTCTTTCATGAATCAAG | 61 | 17929 | 17945 | 236 |
| 539302 | n/a | n/a | Intron 1 | GGTCTTTCATGAATCAA | 93 | 17930 | 17946 | 237 |
| 539303 | n/a | n/a | Intron 1 | ATGGTCTTTCATGAATC | 74 | 17932 | 17948 | 238 |
| 539304 | n/a | n/a | Intron 1 | GATGGTCTTTCATGAAT | 56 | 17933 | 17949 | 239 |
| 539305 | n/a | n/a | Intron 1 | TATATCAATATTCTCCC | 42 | 21820 | 21836 | 240 |
| 539306 | n/a | n/a | Intron 1 | TTATATCAATATTCTCC | 33 | 21821 | 21837 | 241 |
| 539307 | n/a | n/a | Intron 1 | GTTATATCAATATTCTC | 12 | 21822 | 21838 | 242 |
| 539308 | n/a | n/a | Intron 1 | TTTCTTTAGCAATAGTT | 21 | 22518 | 22534 | 243 |
| 539309 | n/a | n/a | Intron 1 | CTTTCTTTAGCAATAGT | 38 | 22519 | 22535 | 244 |
| 539310 | n/a | n/a | Intron 1 | GCTTTCTTTAGCAATAG | 39 | 22520 | 22536 | 245 |
| 539311 | n/a | n/a | Intron 1 | AGGAATGGAAAACCAAA | 18 | 26497 113031 121988 | 26513 113047 122004 | 246 |
| 539312 | n/a | n/a | Intron 1 | CAGGAATGGAAAACCAA | 40 | 26498 113032 121989 | 26514 113048 122005 | 247 |
| 539313 | n/a | n/a | Intron 1 | TCAGGAATGGAAAACCA | 49 | 26499 113033 121990 | 26515 113049 122006 | 248 |
| 539314 | n/a | n/a | Intron 1 | TCTCCATTAGGGTTCTG | 87 | 50948 | 50964 | 249 |
| 539315 | n/a | n/a | Intron 1 | TTCTCCATTAGGGTTCT | 57 | 50949 | 50965 | 250 |
| 539316 | n/a | n/a | Intron 1 | GTTCTCCATTAGGGTTC | 73 | 50950 | 50966 | 251 |
| 539317 | n/a | n/a | Intron 1 | AGGTTGGCAGACAGACA | 73 | 53466 | 53482 | 252 |
| 539318 | n/a | n/a | Intron 1 | CAGGTTGGCAGACAGAC | 84 | 53467 | 53483 | 253 |
| 539319 | n/a | n/a | Intron 1 | GCAGGTTGGCAGACAGA | 85 | 53468 | 53484 | 254 |
| 539320 | n/a | n/a | Intron 1 | CTTCTTGTGAGCTGGCT | 87 | 64884 | 64900 | 255 |
| 539321 | n/a | n/a | Intron 1 | TCTTCTTGTGAGCTGGC | 89 | 64885 | 64901 | 256 |
| 539322 | n/a | n/a | Intron 1 | GTCTTCTTGTGAGCTGG | 87 | 64886 | 64902 | 257 |
| 539323 | n/a | n/a | Intron 1 | AGTCTTCTTGTGAGCTG | 70 | 64887 | 64903 | 258 |
| 539324 | n/a | n/a | Intron 1 | TCTTCCACTCACATCCA | 65 | 65990 | 66006 | 259 |
| 539325 | n/a | n/a | Intron 1 | CTCTTCCACTCACATCC | 78 | 65991 | 66007 | 260 |
| 539326 | n/a | n/a | Intron 1 | TCTCTTCCACTCACATC | 68 | 65992 | 66008 | 261 |
| 539327 | n/a | n/a | Intron 1 | GTCTCTTCCACTCACAT | 74 | 65993 | 66009 | 262 |

TABLE 126-continued

Inhibition of GHR mRNA by 3-10-4 MOE gapmers targeting intronic and exonic regions of SEQ ID NO: 1 and 2

| ISIS NO | SEQ ID NO: 1 Start Site | SEQ ID NO: 1 Stop Site | Target Region | Sequence | % inhibition | SEQ ID NO: 2 Start Site | SEQ ID NO: 2 Stop Site | SEQ ID NO |
|---|---|---|---|---|---|---|---|---|
| 539328 | n/a | n/a | Intron 1 | ATAGATTTTGACTTCCC | 57 | 72107 | 72123 | 263 |
| 539329 | n/a | n/a | Intron 1 | CATAGATTTTGACTTCC | 35 | 72108 | 72124 | 264 |
| 539330 | n/a | n/a | Intron 1 | GCATAGATTTTGACTTC | 53 | 72109 | 72125 | 265 |
| 539331 | n/a | n/a | Intron 1 | AAAATGTCAACAGTGCA | 86 | 80639 | 80655 | 266 |
| 539332 | n/a | n/a | Intron 1 | CAAAATGTCAACAGTGC | 73 | 80640 | 80656 | 267 |
| 539333 | n/a | n/a | Intron 1 | CCAAAATGTCAACAGTG | 34 | 80641 | 80657 | 268 |
| 539334 | n/a | n/a | Intron 1 | CCCAAAATGTCAACAGT | 66 | 80642 | 80658 | 269 |
| 539335 | n/a | n/a | Intron 1 | CATGACTATGTTCTGGC | 67 | 125594 | 125610 | 270 |
| 539336 | n/a | n/a | Intron 1 | ACATGACTATGTTCTGG | 42 | 125595 | 125611 | 271 |
| 539337 | n/a | n/a | Intron 1 | CACATGACTATGTTCTG | 29 | 125596 | 125612 | 272 |
| 539338 | n/a | n/a | Intron 2 | GAATTCTGAGCTCTGGA | 77 | 145429 | 145445 | 273 |
| 539339 | n/a | n/a | Intron 2 | TGAATTCTGAGCTCTGG | 84 | 145430 | 145446 | 274 |
| 539340 | n/a | n/a | Intron 2 | CTGAATTCTGAGCTCTG | 80 | 145431 | 145447 | 275 |
| 539341 | n/a | n/a | Intron 2 | CCTGAATTCTGAGCTCT | 84 | 145432 | 145448 | 276 |
| 539342 | n/a | n/a | Intron 2 | GCCTGAATTCTGAGCTC | 84 | 145433 | 145449 | 277 |
| 539343 | n/a | n/a | Intron 2 | AGCCTGAATTCTGAGCT | 80 | 145434 | 145450 | 278 |
| 539344 | n/a | n/a | Intron 2 | ATATTGTAATTCTTGGT | 0 | 148059 | 148075 | 279 |
| 539345 | n/a | n/a | Intron 2 | GATATTGTAATTCTTGG | 20 | 148060 | 148076 | 280 |
| 539346 | n/a | n/a | Intron 2 | TGATATTGTAATTCTTG | 13 | 148061 | 148077 | 281 |
| 539347 | n/a | n/a | Intron 2 | CTGATATTGTAATTCTT | 8 | 148062 | 148078 | 282 |
| 539348 | n/a | n/a | Intron 2 | CCTGATATTGTAATTCT | 67 | 148063 | 148079 | 283 |
| 539349 | n/a | n/a | Intron 2 | GCCTGATATTGTAATTC | 73 | 148064 | 148080 | 284 |
| 539350 | n/a | n/a | Intron 2 | TGCCTGATATTGTAATT | 32 | 148065 | 148081 | 285 |
| 539351 | n/a | n/a | Intron 2 | AATTATGTGCTTTGCCT | 58 | 148907 | 148923 | 286 |
| 539352 | n/a | n/a | Intron 2 | CAATTATGTGCTTTGCC | 82 | 148908 | 148924 | 287 |
| 539353 | n/a | n/a | Intron 2 | TCAATTATGTGCTTTGC | 68 | 148909 | 148925 | 288 |
| 539354 | n/a | n/a | Intron 2 | GTCAATTATGTGCTTTG | 80 | 148910 | 148926 | 289 |
| 539355 | n/a | n/a | Intron 2 | GCCATCACCAAACACCA | 94 | 150972 | 150988 | 290 |
| 539356 | n/a | n/a | Intron 2 | TGCCATCACCAAACACC | 84 | 150973 | 150989 | 291 |
| 539357 | n/a | n/a | Intron 2 | TTGCCATCACCAAACAC | 74 | 150974 | 150990 | 292 |
| 539358 | n/a | n/a | Intron 2 | TGGTGACTCTGCCTGAT | 85 | 151387 | 151403 | 293 |
| 539359 | n/a | n/a | Intron 2 | CTGGTGACTCTGCCTGA | 86 | 151388 | 151404 | 294 |

TABLE 127

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 523561 | TATTTCAGAAAGACTTTCTG | 11 | 10373 | 10392 | 295 |
| 523562 | AGGAAAAAATCAAGGAGTTA | 8 | 11173 | 11192 | 296 |
| 523563 | TATTTACTGAACACCTATTC | 12 | 11973 | 11992 | 297 |
| 523564 | GCCCATGAAGGCCACTCTTC | 70 | 12780 | 12799 | 298 |
| 523565 | ACCTATAAATAAAGTGAGGA | 0 | 13581 | 13600 | 299 |
| 523566 | GTTTCATAACCTGCTAATAA | 40 | 14451 | 14470 | 300 |
| 523567 | ATGTGCCTTACAGTTATCAG | 36 | 15251 | 15270 | 301 |
| 523568 | TTCTGAATTTAGAATTATAG | 0 | 16051 | 16070 | 302 |
| 523569 | GTTTATAATCTAGCAGTTAC | 26 | 17130 | 17149 | 303 |
| 523570 | GATGGTCTTTCATGAATCAA | 62 | 17930 | 17949 | 304 |
| 523571 | CATGTACCCAAACCAACACT | 65 | 18730 | 18749 | 305 |
| 523572 | TAAAATACAGCCTACATCAT | 0 | 19637 | 19656 | 306 |
| 523573 | CCATCACTACAACAAACTCA | 39 | 20451 | 20470 | 307 |
| 523574 | ATCTGAAATGATCCCCTTTC | 33 | 21283 | 21302 | 308 |
| 523575 | TGTTGCCCCTCCAAAAGAC | 12 | 22144 | 22163 | 309 |
| 523576 | ATTAAAATTTTAAATGATGT | 0 | 22944 | 22963 | 310 |
| 523577 | CTCAGGAATGGAAAACCAAA | 71 | 26497 113031 121988 | 26516 113050 122007 | 311 |
| 523578 | AAAATTCTAGAAGATAACAT | 0 | 27838 | 27857 | 312 |
| 523579 | CTAGAAGTCCTAGCCAGAGT | 2 | 28748 | 28767 | 313 |
| 523580 | AACCGATATCACAGAAATAC | 0 | 29548 | 29567 | 314 |
| 523581 | AAGATAGACAGTAACATAAT | 0 | 30348 | 30367 | 315 |
| 523582 | GCACTACAAGAACTGCTTAA | 40 | 31172 | 31191 | 316 |
| 523583 | TTTCCAGACAAAGAATTCAG | 6 | 31978 | 31997 | 317 |
| 523584 | GTAGACAGCCTTTCTGGAAC | 20 | 32827 | 32846 | 318 |
| 523585 | CATCCTACATAGTGGCTGTG | 47 | 33635 | 33654 | 319 |
| 523586 | CAGAACAGTGTGTGGAGACT | 8 | 34452 | 34471 | 320 |
| 523587 | AGCTTTAAAAATACCTCTGC | 52 | 35466 | 35485 | 321 |
| 523588 | CCCAGGTACTTGCTCTCAGA | 22 | 36266 | 36285 | 322 |
| 523589 | TTACACCTGATTCTAGAAAT | 30 | 37066 | 37085 | 323 |
| 523590 | CTTTTCTCTACAACCTCACA | 34 | 38094 | 38113 | 324 |
| 523591 | TAGTAGTTTGAATTTCAAAG | 1 | 38909 | 38928 | 325 |
| 523592 | ATACAAAATTACTGCAGTCA | 60 | 39719 | 39738 | 326 |
| 523593 | GCCACTGCCAAAAAGGAGGA | 30 | 40519 | 40538 | 327 |
| 523594 | TGACAGAAACAGAGCTATGA | 33 | 41342 | 41361 | 328 |
| 523595 | ATCTTTTAGTATGAACCTTA | 65 | 42142 | 42161 | 329 |

TABLE 127-continued

Inhibition of GHR mRNA by 5-10-5 MOE
gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 523596 | AGTTATGTGACTCTGAGCAC | 63 | 43173 | 43192 | 330 |
| 523597 | ACTATGCCCTAGTTACTTCT | 29 | 43973 | 43992 | 331 |
| 523598 | TATAGTGGAAGTGATAGATC | 0 | 44812 | 44831 | 332 |
| 523599 | TGTTTTCTGAAATGGAATGT | 0 | 45733 | 45752 | 333 |
| 523600 | GCTGTAAATGTAATGAGTGT | 34 | 46553 | 46572 | 334 |
| 523601 | GAGAGAAGCCATGGCCCTAG | 20 | 47392 | 47411 | 335 |
| 523602 | CTCTCTTTCCCAGAACAAGA | 32 | 48210 | 48229 | 336 |
| 523603 | TCCAAAATGTCCAGTATAAT | 33 | 50072 | 50091 | 337 |
| 523604 | GTTCTCCATTAGGGTTCTGG | 74 | 50947 | 50966 | 338 |
| 523605 | TTAGTCACCCATCCACCACT | 41 | 51747 | 51766 | 339 |
| 523606 | CATGAATTCACCGAGTTAGG | 51 | 52573 | 52592 | 340 |
| 523607 | AGCAGGTTGGCAGACAGACA | 62 | 53466 | 53485 | 341 |
| 523608 | GAAAGACTTAAATTTTCACA | 0 | 54306 | 54325 | 342 |
| 523609 | TAGTAGAGGAAAAGGAGAAT | 0 | 55730 | 55749 | 343 |
| 523610 | AAACAGGGTCTGGAGTGGAC | 3 | 61243 | 61262 | 344 |
| 523611 | CAAGCTGATAATTAAAAAGA | 0 | 62462 | 62481 | 345 |
| 523612 | ATAAAGATACATTTTCTGGG | 8 | 63277 | 63296 | 346 |
| 523613 | CAGGATTCTTCCTGCCTGGC | 47 | 64085 | 64104 | 347 |
| 523614 | AAGTCTTCTTGTGAGCTGGC | 71 | 64885 | 64904 | 348 |
| 523615 | CTCTTCCACTCACATCCATT | 63 | 65988 | 66007 | 349 |
| 523616 | CCTATATCAGAAGACAAATG | 5 | 66806 | 66825 | 350 |
| 523617 | TCAAAACCCTGCCAAGGTAC | 44 | 67662 | 67681 | 351 |
| 523618 | TCATATTCTACTTCTGTTTA | 11 | 68462 | 68481 | 352 |
| 523619 | CATTCCAGTGTTTCAGTAAG | 13 | 69262 | 69281 | 353 |
| 523620 | GGCCTGGAATTAATCCTCAG | 49 | 70114 | 70133 | 354 |
| 523621 | AATGCCCTCTCCCTGTGCCT | 48 | 70925 | 70944 | 355 |
| 523622 | TTTATAATCAACCTTTGCTA | 9 | 71741 | 71760 | 356 |
| 523623 | ATATAACTACTTAAAATAAT | 0 | 72541 | 72560 | 357 |
| 523624 | TTAGCCAGGATATGGTTGCC | 50 | 73350 | 73369 | 358 |
| 523625 | CTACCTCCATCAAAGAAAAT | 0 | 74190 | 74209 | 359 |
| 523626 | GCATGCATAGATAAGTTTGA | 20 | 74990 | 75009 | 360 |
| 523627 | ATGAGAGTAAATGGATTTTC | 10 | 75790 | 75809 | 361 |
| 523628 | TTGGCAATCCTTGCTTAAAA | 34 | 76598 | 76617 | 362 |
| 523629 | GAATTAAGCCAGACTTATTT | 3 | 77398 | 77417 | 363 |
| 523630 | GGCTAAGTATTTGTAGCAGT | 55 | 78198 | 78217 | 364 |
| 523631 | TTGCCTGTGTGCAACTGGCG | 0 | 79005 | 79024 | 365 |

TABLE 127-continued

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 523632 | GTGGCCTTAGTAGGCCAGCT | 0 | 79827 | 79846 | 366 |
| 523633 | CCCAAAATGTCAACAGTGCA | 70 | 80639 | 80658 | 367 |
| 523634 | TTAAGCCTTCAATTTGAAAA | 0 | 81455 | 81474 | 368 |
| 523635 | TGCTCAGAAGGTTGAGCATA | 0 | 82261 | 82280 | 369 |
| 523636 | TTAATGCTTTCCCAAAGCTC | 35 | 83061 | 83080 | 370 |
| 523637 | AAAAGACTTCATACCTTTAC | 52 | 83884 | 83903 | 371 |

TABLE 128

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532146 | GGCCCCCTGGCACAACAGGA | 60 | 3097 | 3116 | 372 |
| 532147 | TCTAGGGTGATTCAGGTGGA | 62 | 4537 | 4556 | 373 |
| 532148 | CTTAGATTAATGCAAAACAA | 25 | 4875 | 4894 | 374 |
| 532149 | AGGCAGAGGAGGGTGGAACC | 34 | 6246 | 6265 | 375 |
| 532150 | AGTCTAATGAGATCTGATGG | 76 | 6499 | 6518 | 376 |
| 532151 | GCTGAAATGAGTTAAGACTT | 89 | 6737 | 6756 | 377 |
| 532152 | ACTTTGGACTGTGGATTTTT | 78 | 6765 | 6784 | 378 |
| 532153 | GCATATTTACACAATGCCTG | 84 | 6871 | 6890 | 379 |
| 532154 | GGAAATGCCTGGATGTCCAG | 27 | 7241 | 7260 | 380 |
| 532155 | CTGCTGATTTTGGAATGGAG | 68 | 10660 | 10679 | 381 |
| 532156 | ACTGAACACCTATTCTATGG | 51 | 11968 | 11987 | 382 |
| 532157 | TTTACTGAACACCTATTCTA | 23 | 11971 | 11990 | 383 |
| 532158 | CCCTCAAATTATCCACAAAC | 89 | 12053 | 12072 | 384 |
| 532159 | CTTCTAAATGTTTCCAAGGC | 63 | 12186 | 12205 | 385 |
| 532160 | TTACATCCTGTAGGCTAATT | 82 | 12469 | 12488 | 386 |
| 532161 | CCACTAGCCTGGCCAGACTT | 73 | 12487 | 12506 | 387 |
| 532162 | CTGGTAGATGATCTCAAGTT | 84 | 13351 | 13370 | 388 |
| 532163 | AAAGAATTGAGTTATAAATC | 23 | 13670 | 13689 | 389 |
| 532164 | AACTCATCTCTGGCCAGCAG | 89 | 14361 | 14380 | 390 |
| 532165 | CAACATCATTGTATTTTCTG | 33 | 14965 | 14984 | 391 |
| 532166 | TCTTAGCTTACCAATGAGGA | 81 | 15085 | 15104 | 392 |
| 532167 | TTCCCAGAGCCAAAGCTCAA | 77 | 15982 | 16001 | 393 |
| 532168 | TTTGGCCAATCCCAGCTTAT | 59 | 16253 | 16272 | 394 |

TABLE 128-continued

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532169 | GTTTGCAAATCTTCATTCAC | 71 | 16447 | 16466 | 395 |
| 532170 | CAATAGTCCCTGAGGCTTGG | 74 | 16476 | 16495 | 396 |
| 532171 | TTTCCCCAGATTAAATGCCC | 85 | 17650 | 17669 | 397 |
| 532172 | TTCAATAATGCAGTTATTAT | 0 | 18308 | 18327 | 398 |
| 532173 | AAATTCTTGGGCTTAAGCAC | 69 | 18638 | 18657 | 399 |
| 532174 | ACATGTACCCAAACCAACAC | 71 | 18731 | 18750 | 91 |
| 532175 | TGATCCAAATTCAGTACCTA | 82 | 18752 | 18771 | 400 |
| 532176 | GATGATCCAAATTCAGTACC | 54 | 18754 | 18773 | 401 |
| 532177 | CAATATTCATCTTTATATTC | 25 | 19106 | 19125 | 402 |
| 532178 | ATTGCTCTTAAGATAAGTAA | 41 | 19661 | 19680 | 403 |
| 532179 | CAGCTCCCTGAATATCTCTT | 74 | 19783 | 19802 | 404 |
| 532180 | ACTTCACAAATATATTATAA | 0 | 19885 | 19904 | 405 |
| 532181 | GTACAGTCAACTTTACTTCA | 89 | 19899 | 19918 | 406 |
| 532182 | CAATTCCCACTCTTGTCAAC | 55 | 20288 | 20307 | 407 |
| 532183 | TCAACTGCTTTCTGGAGCAG | 66 | 21215 | 21234 | 408 |
| 532184 | ACTGCTGAGCACCTCCAAAA | 73 | 21454 | 21473 | 409 |
| 532185 | CTTAGATTCCTGGTTTATCA | 78 | 21587 | 21606 | 410 |
| 532186 | AGTTATATCAATATTCTCCC | 88 | 21820 | 21839 | 411 |
| 532187 | TATACCATCTTCCCCATAAA | 32 | 22038 | 22057 | 412 |
| 532188 | GGCTTTCTTTAGCAATAGTT | 86 | 22518 | 22537 | 413 |
| 532189 | TACCAGGGATGTAGGTTTAC | 82 | 29050 | 29069 | 414 |
| 532190 | TCACAGCTGAATTCTATCTG | 80 | 29323 | 29342 | 415 |
| 532191 | GGAGATGGACAAATTCCTGC | 77 | 29470 | 29489 | 416 |
| 532192 | CTAGACATGTCATCAAGACA | 19 | 30294 | 30313 | 417 |
| 532193 | CAAATTAATAAAACAATTAC | 10 | 30385 | 30404 | 418 |
| 532194 | TATTCTTATATCAGACAAAA | 30 | 30532 | 30551 | 419 |
| 532195 | TCAAGGGATCCCTGCCATTC | 32 | 32361 | 32380 | 420 |
| 532196 | CGTCAAGGGATCCCTGCCAT | 47 | 32363 | 32382 | 421 |
| 532197 | GGCACTCCCAGTCTCCAGCT | 83 | 34138 | 34157 | 422 |
| 532198 | TTTCTCCAGCAGAAGTGTCA | 60 | 34845 | 34864 | 423 |
| 532199 | AAGTCCTCTTCCGCCTCCCT | 82 | 36023 | 36042 | 424 |
| 532200 | GGAATTTACCAAAAACAGTT | 63 | 36721 | 36740 | 425 |
| 532201 | AGTTAGGTATTGTCCATTTT | 74 | 37032 | 37051 | 426 |
| 532202 | ACATGGGTATCTTCTAGGAA | 77 | 37111 | 37130 | 427 |
| 532203 | TCAGTTTCAGAGAGACAAAA | 41 | 37276 | 37295 | 428 |
| 532204 | TTTGCCAGGTCCTATGTCGA | 69 | 37656 | 37675 | 429 |

TABLE 128-continued

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532205 | ATTCCCTTTTCTCTACAACC | 70 | 38099 | 38118 | 430 |
| 532206 | ATGATAAGAGCCAAGATTTG | 13 | 38994 | 39013 | 431 |
| 532207 | GAAAAAGGTCCACTGTGGT | 49 | 40356 | 40375 | 432 |
| 532208 | CCTGTCCTGGAATAGTTTCA | 49 | 41164 | 41183 | 433 |
| 532209 | TAGAAAAGTAAATAAGGAAT | 15 | 41501 | 41520 | 434 |
| 532210 | TTATAAAACTATGCAATAGG | 0 | 41889 | 41908 | 435 |
| 532211 | TTATTTCATATTTCCAGAAA | 0 | 42675 | 42694 | 436 |
| 532212 | CATGAATTACAGCTAAAGAT | 20 | 42741 | 42760 | 437 |
| 532213 | TTGCATGTATGTGTTTCTGA | 62 | 43518 | 43537 | 438 |
| 532214 | TCAATCTCTTTATACCCTTA | 75 | 43765 | 43784 | 439 |
| 532215 | TCTTCAATCTCTTTATACCC | 58 | 43768 | 43787 | 440 |
| 532216 | CTATGCCCTAGTTACTTCTA | 47 | 43972 | 43991 | 441 |
| 532217 | AAAGAGAATCTCTTCCTTTT | 27 | 44070 | 44089 | 442 |
| 532218 | TCATTAAAGATTATTATAAC | 0 | 44222 | 44241 | 443 |
| 532219 | TTTGGATGAGTGGAAGGCTA | 0 | 44528 | 44547 | 444 |
| 532220 | GGAAATGGCCTTTTTCCTTA | 72 | 45400 | 45419 | 445 |
| 532221 | GGAGAAGCCCTCTGCCTGTA | 60 | 46477 | 46496 | 446 |
| 532222 | AAACCATATTGTCCACCAGA | 84 | 46510 | 46529 | 447 |

TABLE 129

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532223 | CTCAAACCATATTGTCCACC | 90 | 46513 | 46532 | 448 |
| 532224 | GTGTAAATAGTGACTTGTAC | 76 | 50123 | 50142 | 449 |
| 532225 | TGAGGCACAGGAAAGTTAAC | 52 | 50719 | 50738 | 450 |
| 532226 | AGCTATAGTTCTCCATTAGG | 74 | 50954 | 50973 | 451 |
| 532227 | TTACTTGCTGACTAAGCCAT | 69 | 51071 | 51090 | 452 |
| 532228 | GTTTGTCAACTCAACATCAA | 73 | 51215 | 51234 | 453 |
| 532229 | GACTATTTGTATATATATAC | 33 | 51491 | 51510 | 454 |
| 532230 | ATGACTATTTGTATATATAT | 11 | 51493 | 51512 | 455 |
| 532231 | ACTCTTCCTTATATTTGCTC | 76 | 51778 | 51797 | 456 |
| 532232 | ATACACTGACTTTTAACATT | 67 | 52039 | 52058 | 457 |

TABLE 129-continued

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532233 | CTTAGAAACAGTAGTTTCAT | 42 | 52124 | 52143 | 458 |
| 532234 | CTGAGCTTTGCCTTAAGAAT | 79 | 52633 | 52652 | 459 |
| 532235 | CACCAGACAGCAGGTAGAGC | 81 | 53540 | 53559 | 460 |
| 532236 | GAGATGGAGTAGAAGGCAAA | 43 | 55926 | 55945 | 461 |
| 532237 | TAGGAAAGGAAGAATACACT | 33 | 63881 | 63900 | 462 |
| 532238 | TAGACCAGGAAGGGTGAGAG | 27 | 64376 | 64395 | 463 |
| 532239 | AAGTTGGATCTGGCATGCAT | 64 | 64574 | 64593 | 464 |
| 532240 | AAAGTTGGATCTGGCATGCA | 70 | 64575 | 64594 | 465 |
| 532241 | CCATAACTCTTCTAACTGGG | 84 | 64643 | 64662 | 466 |
| 532242 | ATATTAAAGTTTGAGAACTA | 37 | 65080 | 65099 | 467 |
| 532243 | CTTAACTACAAAATGCTGGA | 71 | 66164 | 66183 | 468 |
| 532244 | TGAGCAGCTGTCCTCAGTTC | 43 | 67061 | 67080 | 469 |
| 532245 | GAGTTCATAAAAGTTTTACT | 26 | 67251 | 67270 | 470 |
| 532246 | CTATCCACACCATTCCATAA | 73 | 69203 | 69222 | 471 |
| 532247 | AACATCTAAGTAATGCAAAC | 58 | 69223 | 69242 | 472 |
| 532248 | TTTGCATTCAAAGCCCTGGG | 91 | 69565 | 69584 | 473 |
| 532249 | TCCATATTATAGGCTATGAT | 73 | 69889 | 69908 | 474 |
| 532250 | ATTTTATGATAATGTAAAAC | 27 | 69942 | 69961 | 475 |
| 532251 | GAGATCACATTTTCTGAGTA | 50 | 70352 | 70371 | 476 |
| 532252 | ACCTCCCTAGGATTACCTCA | 56 | 71617 | 71636 | 477 |
| 532253 | AAAATCTGATTTATAATCAA | 40 | 71750 | 71769 | 478 |
| 532254 | AGCATAGATTTTGACTTCCC | 92 | 72107 | 72126 | 479 |
| 532255 | AAAGTCATATACACAGGTCT | 53 | 72584 | 72603 | 480 |
| 532256 | CTCATAGCAAATTCCCAGAA | 66 | 73689 | 73708 | 481 |
| 532257 | CAACATGGAGGCTAGCATGT | 55 | 74112 | 74131 | 482 |
| 532258 | AGACTAAGTGGCCTGAATGT | 52 | 74317 | 74336 | 483 |
| 532259 | ACCTACCATGTCACTCTCAA | 61 | 74418 | 74437 | 484 |
| 532260 | AACTTTCTTGTGTTTTATCA | 9 | 75511 | 75530 | 485 |
| 532261 | TTTGCAAGACAAAGAAATGA | 31 | 75915 | 75934 | 486 |
| 532262 | CATGCAAAGTGTTCCTCTTC | 63 | 76024 | 76043 | 487 |
| 532263 | AGTGCTTTGCTTTCTCTTAT | 79 | 76047 | 76066 | 488 |
| 532264 | GAACAAGAAACACTTGGTAA | 44 | 76555 | 76574 | 489 |
| 532265 | AGTGTTCCAATTAAATGGCA | 34 | 76643 | 76662 | 490 |
| 532266 | AAACAATGCCCTTGTAGTGA | 57 | 76703 | 76722 | 491 |
| 532267 | TATTCTAGGTTTTGAGGTGA | 60 | 76752 | 76771 | 492 |
| 532268 | ATATTCTAGGTTTTGAGGTG | 24 | 76753 | 76772 | 493 |

TABLE 129-continued

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532269 | GTTTTCCATTCTTTAAGAAA | 41 | 76896 | 76915 | 494 |
| 532270 | AGCAATCCATTGATTGTATG | 59 | 77044 | 77063 | 495 |
| 532271 | AATTATGGCAAAATGGAAAA | 37 | 77076 | 77095 | 496 |
| 532272 | ACATTTGCTTATGAGACTAT | 62 | 77638 | 77657 | 497 |
| 532273 | GCAGAGATAATCCTATGATG | 42 | 77841 | 77860 | 498 |
| 532274 | TCCATCTGTTACCTCTCTGT | 77 | 78122 | 78141 | 499 |
| 532275 | TTTGCCTGAAGGGCAGAACC | 40 | 79478 | 79497 | 500 |
| 532276 | GAAAAAATCAGATTTTCACA | 0 | 79664 | 79683 | 501 |
| 532277 | AACTTAATTTAATCATTTCT | 0 | 79959 | 79978 | 502 |
| 532278 | TTTGGTTGTCATGAGTTGAG | 67 | 80756 | 80775 | 503 |
| 532279 | TTCCATCTCTAGGGCACTTT | 74 | 80900 | 80919 | 504 |
| 532280 | AGAGCTTATTTTCAAAATTC | 36 | 80920 | 80939 | 505 |
| 532281 | ATAAAGAGCAAACAAACATA | 42 | 81524 | 81543 | 506 |
| 532282 | TATAAATTCCTTGGTCTGAT | 33 | 82835 | 82854 | 507 |
| 532283 | AAAATATAAATTCCTTGGTC | 13 | 82839 | 82858 | 508 |
| 532284 | TTTTATAACAGCCTCTGACA | 38 | 82959 | 82978 | 509 |
| 532285 | AAAAGACCATGTTGCTTATT | 72 | 83179 | 83198 | 510 |
| 532286 | ATAGTCAGTCAGAATGTGGT | 72 | 83330 | 83349 | 511 |
| 532287 | TGCCTTAGCTTGGAAAAGAC | 78 | 83897 | 83916 | 512 |
| 532288 | AGGGCTAGCTGATGCCTCTC | 69 | 84026 | 84045 | 513 |
| 532289 | TTGGACTGGGCTCAAACAGA | 72 | 84381 | 84400 | 514 |
| 532290 | AAAGTCAGGCTAGAGGGACT | 49 | 85713 | 85732 | 515 |
| 532291 | TCCTTGTTTTCTTGTAATGA | 50 | 85945 | 85964 | 516 |
| 532292 | ACACCAGAGGAAGGAAATCA | 44 | 86554 | 86573 | 517 |
| 532293 | GATGTACACCATTTTGAATT | 15 | 86629 | 86648 | 518 |
| 532294 | TGCTCTGGCCTAGCCTATGT | 62 | 86901 | 86920 | 519 |
| 532295 | CAGAGGTGTCTCCCAAGAAA | 60 | 89940 | 89959 | 520 |
| 532296 | AAAGAGAATGGATCAAAGCT | 36 | 91930 | 91949 | 521 |
| 532297 | GATTTGCAGAACAAATCTTG | 37 | 93332 | 93351 | 522 |
| 532298 | TGGTTATGAAGGTTGGACCA | 52 | 94839 | 94858 | 523 |
| 532299 | TGGCTAATTAATGGGCAATT | 63 | 95292 | 95311 | 524 |

TABLE 130

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532300 | CTGTGCCATATTGCCTCTAA | 87 | 95471 | 95490 | 525 |
| 532301 | GATTTCAACCAGCTCACCTG | 48 | 95510 | 95529 | 526 |
| 532302 | GCAAAAGGGAACCCTGAAGC | 71 | 95564 | 95583 | 527 |
| 532303 | CTAAGTGTTATAACAAACAC | 43 | 96137 | 96156 | 528 |
| 532304 | GTCCATTGGTATAAAACTCA | 84 | 96282 | 96301 | 529 |
| 532305 | TTTCAATACAATAAGATTTA | 34 | 96793 | 96812 | 530 |
| 532306 | GTCCTTAGACCCCTCAATGG | 62 | 96987 | 97006 | 531 |
| 532307 | GAGGATTTATTCATCTAGGC | 68 | 97806 | 97825 | 532 |
| 532308 | CAGTGGGAGGATCAGATATC | 46 | 97870 | 97889 | 533 |
| 532309 | ATCCCATCCAGCAGCTGGAC | 67 | 98132 | 98151 | 534 |
| 532310 | AACTTGGGATGAGTTACTGA | 56 | 98653 | 98672 | 535 |
| 532311 | GAAGGCTACCTAAAAGAAAT | 43 | 98810 | 98829 | 536 |
| 532312 | AAAGAAATATTCACAACATT | 39 | 99096 | 99115 | 537 |
| 532313 | ATGCTTATACTGCTGCTGTA | 69 | 99791 | 99810 | 538 |
| 532314 | TCCTCACTTCAATCACCTTT | 70 | 99819 | 99838 | 539 |
| 532315 | CTCTTTCTTCATAAATAAGT | 33 | 100809 | 100828 | 540 |
| 532316 | TGGTAATCTGTGTCCCTTTA | 96 | 101242 | 101261 | 541 |
| 532317 | TAATAAAAAAGTTTGAAACA | 41 | 102549 | 102568 | 542 |
| 532318 | GGTGGTGGCAAGAGAAAAAT | 56 | 103015 | 103034 | 543 |
| 532319 | CAAAAGGCCCTTTTTACATG | 28 | 103034 | 103053 | 544 |
| 532320 | ACTCTACTGGTACCAATTTA | 31 | 103173 | 103192 | 545 |
| 532321 | TCTGAACTTTTATGCTCTGT | 76 | 103606 | 103625 | 546 |
| 532322 | AACTTTTGCCTGGGCATCCA | 16 | 104067 | 104086 | 547 |
| 532323 | TGACTCCATGTCTCACATCC | 66 | 104392 | 104411 | 548 |
| 532324 | TTACTTCCTAGATACAACAG | 53 | 104541 | 104560 | 549 |
| 532325 | CTGGCCCCCATGATTCAATT | 44 | 104835 | 104854 | 550 |
| 532326 | AAGACTGGCCCCCATGATTC | 49 | 104839 | 104858 | 551 |
| 532327 | TGTCACTGGTCTGTGTATTT | 60 | 106233 | 106252 | 552 |
| 532328 | ACAGAGTAGATTTAGCATAA | 23 | 106980 | 106999 | 553 |
| 532329 | TAAACAGGTGTACTATTACA | 27 | 107030 | 107049 | 554 |
| 532330 | GCTTTATCAACTAAGTTTAT | 22 | 107716 | 107735 | 555 |
| 532331 | CAGAACTTCTTTTAAAATTG | 8 | 107763 | 107782 | 556 |
| 532332 | GAATACAGACATACCTTGAA | 25 | 108514 | 108533 | 557 |
| 532333 | CCATGACAACAATTTCAGAG | 58 | 109486 | 109505 | 558 |
| 532334 | ACAAATAGCAATGAATGGGT | 45 | 110878 | 110897 | 559 |
| 532335 | CAACAAATAGCAATGAATGG | 47 | 110880 | 110899 | 560 |

TABLE 130-continued

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532336 | GTACACAAATCAGTAGCTCT | 72 | 115087 | 115106 | 561 |
| 532337 | CTATGTCAAAAAGACTGAAA | 4 | 116370 | 116389 | 562 |
| 532338 | ATATACAGAACATTTCATCC | 13 | 116743 | 116762 | 563 |
| 532339 | AGAATAGATAAGAACTCACC | 32 | 117195 | 117214 | 564 |
| 532340 | AGGAAAGATACAGTCATTTT | 5 | 117507 | 117526 | 565 |
| 532341 | GCACAAAGAACACCTGGGAA | 43 | 117781 | 117800 | 566 |
| 532342 | CAAGAAGTCTGGGATTATGT | 0 | 117938 | 117957 | 567 |
| 532343 | GTTAGTTATTAAGCTAATCA | 48 | 118245 | 118264 | 568 |
| 532344 | AACCATTATTTATAGGCTAA | 14 | 119127 | 119146 | 569 |
| 532345 | CCAGAATGCGATCACTTCTT | 76 | 120826 | 120845 | 570 |
| 532346 | CCAGAAATTATCCTCCTCTC | 70 | 121209 | 121228 | 571 |
| 532347 | AGGGAAATGCAAATTAAAAC | 20 | 122479 | 122498 | 572 |
| 532348 | GCATCAAGATACAGAAAAAT | 24 | 122751 | 122770 | 573 |
| 532349 | GAATGTTTATGAGATTTTTC | 0 | 123571 | 123590 | 574 |
| 532350 | GCCAATTATATTGCCACATT | 23 | 124413 | 124432 | 575 |
| 532351 | ATACTTGCTTATGTAGAAAT | 45 | 124589 | 124608 | 576 |
| 532352 | TAATACTTGCTTATGTAGAA | 3 | 124591 | 124610 | 577 |
| 532353 | GAACACATGGCATTCTGATA | 36 | 125178 | 125197 | 578 |
| 532354 | CAGAATTTGCAGTATAAATC | 0 | 126051 | 126070 | 579 |
| 532355 | TATGTTTTGAAATCTTATTT | 0 | 126157 | 126176 | 580 |
| 532356 | ACTCACTGCTACCTCATTAA | 11 | 126998 | 127017 | 581 |
| 532357 | AAGCAGTGATAGGGTATCTG | 59 | 127080 | 127099 | 582 |
| 532358 | ATGAGGCCTATTACAATGGA | 14 | 127170 | 127189 | 583 |
| 532359 | CTGGAGTCTCATGAGGCCTA | 53 | 127180 | 127199 | 584 |
| 532360 | TGACTATCAGCCTTTTAATC | 45 | 127663 | 127682 | 585 |
| 532361 | TTCAGAGAACAACCTTTGAA | 0 | 127959 | 127978 | 586 |
| 532362 | AGCCATGTGTGATCTGATGT | 53 | 128813 | 128832 | 587 |
| 532363 | GAAATTTACTCCAAACTAGC | 17 | 128992 | 129011 | 588 |
| 532364 | AACATCCAGACCACCATCTA | 35 | 130094 | 130113 | 589 |
| 532365 | GTACCAAACCATTCATGCTC | 56 | 131036 | 131055 | 590 |
| 532366 | AGTACCAAACCATTCATGCT | 24 | 131037 | 131056 | 591 |
| 532367 | TTATAGAGCTTGAGATTGAC | 7 | 132165 | 132184 | 592 |
| 532368 | AGTCCATTATAGAGCTTGAG | 58 | 132171 | 132190 | 593 |
| 532369 | AACCATGAGATGCAATGCAG | 40 | 132498 | 132517 | 594 |
| 532370 | AGGATTGAGAATCGCTGATT | 42 | 133168 | 133187 | 595 |

TABLE 130-continued

Inhibition of GHR mRNA by 5-10-5 MOE gapmers targeting intron 1 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532371 | TCTAAAGCATGGCCAGGATT | 48 | 133182 | 133201 | 596 |
| 532372 | GGGACTGAGTATTGATACTT | 44 | 133222 | 133241 | 597 |
| 532373 | AGAAGTAGGGTGTTCCAGAT | 29 | 133523 | 133542 | 598 |
| 532374 | AGAAATAGTCTTCCTACTAA | 0 | 133547 | 133566 | 599 |
| 532375 | GCCTCCTTTAAGCTTCTATG | 22 | 134240 | 134259 | 600 |
| 532376 | GGCCTGCCTTTACTTTCCCA | 36 | 134598 | 134617 | 601 |

TABLE 131

Inhibition of GHR mRNA by 5-10-5 MOE gapmers targeting introns 1 and 2 of SEQ ID NO: 2

| ISIS NO | SEQ ID NO: 1 Start Site | SEQ ID NO: 1 Stop Site | Sequence | Target region | % inhibition | SEQ ID NO: 2 Start Site | SEQ ID NO: 2 Stop Site | SEQ ID NO |
|---|---|---|---|---|---|---|---|---|
| 523638 | n/a | n/a | ACCTCAGTGGACTCTTTCCA | Intron 1 | 4 | 84684 | 84703 | 602 |
| 523639 | n/a | n/a | CAAACCTAAGTTCAAGTCCT | Intron 1 | 62 | 85523 | 85542 | 603 |
| 523640 | n/a | n/a | AGTTTCACTTCTTGAATCAA | Intron 1 | 38 | 86373 | 86392 | 604 |
| 523641 | n/a | n/a | AAGATCAAATGAGGTCAAGG | Intron 1 | 30 | 87181 | 87200 | 605 |
| 523642 | n/a | n/a | TAGATACAAATTTCATCACA | Intron 1 | 23 | 88063 | 88082 | 606 |
| 523643 | n/a | n/a | ATTCCTAAAATAGGAGCAGG | Intron 1 | 45 | 88870 | 88889 | 607 |
| 523644 | n/a | n/a | TTTTTATGTTGTATAAGATA | Intron 1 | 0 | 89670 | 89689 | 608 |
| 523645 | n/a | n/a | GTTCAGCCAATACATGAGTA | Intron 1 | 48 | 90473 | 90492 | 609 |
| 523646 | n/a | n/a | CCAGAGGGAGTTCATTACCA | Intron 1 | 62 | 91273 | 91292 | 610 |
| 523647 | n/a | n/a | TCTCTCTAATTCAACCTTAT | Intron 1 | 44 | 92107 | 92126 | 611 |
| 523648 | n/a | n/a | ATAATCCTCAGACCTCTTTA | Intron 1 | 29 | 92925 | 92944 | 612 |
| 523649 | n/a | n/a | CACTGTGGCAGAATTCCAAG | Intron 1 | 28 | 93762 | 93781 | 613 |
| 523650 | n/a | n/a | ACACCTTGGTGCCTAGAAGC | Intron 1 | 54 | 94581 | 94600 | 614 |
| 523651 | n/a | n/a | GTAGCAATGACACCTAAGAA | Intron 1 | 58 | 95394 | 95413 | 615 |
| 523652 | n/a | n/a | TTTAAAATAATAAATGCTTA | Intron 1 | 0 | 96194 | 96213 | 616 |
| 523653 | n/a | n/a | TCATTTGGTCCTTAGACCCC | Intron 1 | 27 | 96994 | 97013 | 617 |
| 523654 | n/a | n/a | TTATTCATCTAGGCCGAGTG | Intron 1 | 57 | 97800 | 97819 | 618 |
| 523655 | n/a | n/a | TTGCAGAATCTTCTCTTTGG | Intron 1 | 65 | 98627 | 98646 | 619 |
| 523656 | n/a | n/a | ACCATAAAGCTATGCCATAA | Intron 1 | 63 | 99481 | 99500 | 620 |
| 523657 | n/a | n/a | GGCAAGGAGCACAATAGGAC | Intron 1 | 20 | 100281 | 100300 | 621 |
| 523658 | n/a | n/a | ACCCAAAAAGTTGAGCTGAG | Intron 1 | 66 | 101081 | 101100 | 622 |
| 523659 | n/a | n/a | TAGATTTTCAGACTCTTTCT | Intron 1 | 46 | 101887 | 101906 | 623 |
| 523660 | n/a | n/a | AATTTCAATATTGTTGTGTT | Intron 1 | 0 | 102760 | 102779 | 624 |

TABLE 131-continued

Inhibition of GHR mRNA by 5-10-5 MOE gapmers targeting introns 1 and 2 of SEQ ID NO: 2

| ISIS NO | SEQ ID NO: 1 Start Site | SEQ ID NO: 1 Stop Site | Sequence | Target region | % inhibition | SEQ ID NO: 2 Start Site | SEQ ID NO: 2 Stop Site | SEQ ID NO |
|---|---|---|---|---|---|---|---|---|
| 523661 | n/a | n/a | ATGCTTTTAATGGCACCCAA | Intron 1 | 69 | 103569 | 103588 | 625 |
| 523662 | n/a | n/a | CATGTCTCACATCCAGGTCA | Intron 1 | 37 | 104386 | 104405 | 626 |
| 523663 | n/a | n/a | TTCACTGGAGTAGACTTTTA | Intron 1 | 45 | 105255 | 105274 | 627 |
| 523664 | n/a | n/a | CTTATAAGGGAGGTCTGGTA | Intron 1 | 41 | 106147 | 106166 | 628 |
| 523665 | n/a | n/a | GCATAATTCTTAAGGGCCCT | Intron 1 | 71 | 106966 | 106985 | 629 |
| 523666 | n/a | n/a | CCACAGAACTTCTTTTAAAA | Intron 1 | 27 | 107766 | 107785 | 630 |
| 523667 | n/a | n/a | GGTGACCATGATTTTAACAA | Intron 1 | 25 | 108566 | 108585 | 631 |
| 523668 | n/a | n/a | AACAGCTGCATGACAATTTT | Intron 1 | 50 | 109382 | 109401 | 632 |
| 523669 | n/a | n/a | AGAAACAGAATCAGTGACTT | Intron 1 | 44 | 110403 | 110422 | 633 |
| 523670 | n/a | n/a | CAGATTCCAGAGAAAAGCCA | Intron 1 | 14 | 111203 | 111222 | 634 |
| 523671 | n/a | n/a | TGTGAGAAGAACTCTATCAC | Intron 1 | 12 | 112030 | 112049 | 635 |
| 523672 | n/a | n/a | CTCACAAATCACCACTAAAG | Intron 1 | 31 | 112842 | 112861 | 636 |
| 523673 | n/a | n/a | CAACGAGTGGATAAAGAAAC | Intron 1 | 28 | 113646 | 113665 | 637 |
| 523674 | n/a | n/a | ATAAAACTGGATCCTCATCT | Intron 1 | 13 | 114446 | 114465 | 638 |
| 523675 | n/a | n/a | ATTAAAACTCTCAGCAAAAT | Intron 1 | 0 | 115450 | 115469 | 639 |
| 523676 | n/a | n/a | AAAGACTGAAAGAACACAAA | Intron 1 | 0 | 116361 | 116380 | 640 |
| 523677 | n/a | n/a | TATCTGCTGCCTTCAGGAGA | Intron 1 | 0 | 117168 | 117187 | 641 |
| 523678 | n/a | n/a | TTTGAATTAACCCAATTCAA | Intron 1 | 0 | 117999 | 118018 | 642 |
| 523679 | n/a | n/a | TCTTAATTTACAACAGAGGA | Intron 1 | 25 | 118821 | 118840 | 643 |
| 523680 | n/a | n/a | AGAAAAGTGACAGGCTTCCC | Intron 1 | 31 | 119659 | 119678 | 644 |
| 523681 | n/a | n/a | ATGTTCCTTGAAGATCCCAA | Intron 1 | 37 | 120478 | 120497 | 645 |
| 523682 | n/a | n/a | ATGAATAACACTTGCCACAA | Intron 1 | 0 | 121379 | 121398 | 646 |
| 523683 | n/a | n/a | GTATGTTTATCACAGCACAG | Intron 1 | 56 | 122180 | 122199 | 647 |
| 523684 | n/a | n/a | AAACACTGCAATATTAGGTT | Intron 1 | 34 | 123031 | 123050 | 648 |
| 523685 | n/a | n/a | GATTGGTGCTTTTCAAACTG | Intron 1 | 39 | 123936 | 123955 | 649 |
| 523686 | n/a | n/a | ATTTGTAAGACAAACATGAA | Intron 1 | 9 | 124764 | 124783 | 650 |
| 523687 | n/a | n/a | TCACATGACTATGTTCTGGC | Intron 1 | 72 | 125594 | 125613 | 651 |
| 523688 | n/a | n/a | AGTCCTGTCCACACTATTAA | Intron 1 | 6 | 126415 | 126434 | 652 |
| 523689 | n/a | n/a | CTGGGCTCTGCCTGCTGAAC | Intron 1 | 17 | 127217 | 127236 | 653 |
| 523690 | n/a | n/a | AAAACCCTTAAGTATTTCCT | Intron 1 | 12 | 128054 | 128073 | 654 |
| 523691 | n/a | n/a | CTCTGTTTCAAACCCCCAG | Intron 1 | 21 | 128854 | 128873 | 655 |
| 523692 | n/a | n/a | GGACAGAACACCAATCACAA | Intron 1 | 18 | 129654 | 129673 | 656 |
| 523693 | n/a | n/a | ACCTACCCTTCAAAGTCACG | Intron 1 | 0 | 130486 | 130505 | 657 |
| 523694 | n/a | n/a | TTCAGTTCCCAGGAGGCTTA | Intron 1 | 5 | 131286 | 131305 | 658 |
| 523695 | n/a | n/a | TTTTGCAATGTCTAGCAATT | Intron 1 | 0 | 132086 | 132105 | 659 |

TABLE 131-continued

Inhibition of GHR mRNA by 5-10-5 MOE gapmers targeting introns 1 and 2 of SEQ ID NO: 2

| ISIS NO | SEQ ID NO: 1 Start Site | SEQ ID NO: 1 Stop Site | Sequence | Target region | % inhibition | SEQ ID NO: 2 Start Site | SEQ ID NO: 2 Stop Site | SEQ ID NO |
|---|---|---|---|---|---|---|---|---|
| 523696 | n/a | n/a | ATTAAGATCAGAAAATATTA | Intron 1 | 0 | 132953 | 132972 | 660 |
| 523697 | n/a | n/a | TTAATGAGATATTTTGCACC | Intron 1 | 34 | 133858 | 133877 | 661 |
| 523698 | n/a | n/a | GAGAGGTTAAGTAAATCTCC | Intron 1 | 0 | 134678 | 134697 | 662 |
| 523699 | n/a | n/a | CAGACTCAAATTTGAAAATT | Intron 1 | 14 | 135500 | 135519 | 663 |
| 523700 | n/a | n/a | GATAAGGCAATAATACAGCC | Intron 1 | 1 | 136306 | 136325 | 664 |
| 523701 | n/a | n/a | ATCATTTGCCAATTTCTGTG | Intron 1 | 28 | 137133 | 137152 | 665 |
| 523702 | n/a | n/a | CAAGAAGAAAAGATGCAAAA | Intron 1 | 0 | 138035 | 138054 | 666 |
| 523703 | n/a | n/a | AATTTATTTCCTTCCTATGA | Intron 1 | 0 | 138857 | 138876 | 667 |
| 523704 | n/a | n/a | TTTTGGAAATGTGAGAAACG | Intron 1 | 0 | 139771 | 139790 | 668 |
| 523705 | n/a | n/a | AAACACATGAGAAAAGATGA | Intron 1 | 0 | 140593 | 140612 | 669 |
| 523706 | n/a | n/a | TGTTGGCTCAGTGGGAATGA | Intron 1 | 0 | 141412 | 141431 | 670 |
| 523707 | n/a | n/a | TGAACAGGTTTGCATTTCTC | Intron 1 | 42 | 142229 | 142248 | 671 |
| 523708 | n/a | n/a | TCCTAGGTGAACAGGCTATG | Intron 1 | 38 | 143029 | 143048 | 672 |
| 523709 | n/a | n/a | CCCTAATCAGGCTGAAATAA | Intron 1 | 0 | 143829 | 143848 | 673 |
| 523710 | n/a | n/a | AGGGCCAGTAAGGTTTGCTT | Intron 1 | 12 | 144631 | 144650 | 674 |
| 523711 | n/a | n/a | AGCCTGAATTCTGAGCTCTG | Intron 2 | 88 | 145431 | 145450 | 675 |
| 523712 | n/a | n/a | AGAGGATCTCAGCTGCAATT | Intron 2 | 71 | 146238 | 146257 | 676 |
| 523713 | n/a | n/a | GAAAATCCCTGCTCAAGTGC | Intron 2 | 67 | 147262 | 147281 | 677 |
| 523714 | n/a | n/a | TGCCTGATATTGTAATTCTT | Intron 2 | 90 | 148062 | 148081 | 678 |

TABLE 132

Inhibition of GHR mRNA by 5-10-5 MOE gapmers targeting introns 1 and 2 of SEQ ID NO: 2

| ISIS NO | Sequence | Target Region | % inhibition | SEQ ID NO: 2 Start Site | SEQ ID NO: 2 Stop Site | SEQ ID NO |
|---|---|---|---|---|---|---|
| 532377 | CTCATACAGTGAAGTCTTCA | Intron 1 | 73 | 135431 | 135450 | 679 |
| 532378 | CTCACTAAGCTTGATTCACT | Intron 1 | 67 | 135818 | 135837 | 680 |
| 532379 | GATACAGAAATCCCAGTGAC | Intron 1 | 46 | 136111 | 136130 | 681 |
| 532380 | TGTGCTTGGGTGTACAGGCA | Intron 1 | 71 | 136282 | 136301 | 682 |
| 532381 | TCAAGCACTTACATCATATG | Intron 1 | 42 | 136377 | 136396 | 683 |
| 532382 | AGGGTTAGTTATTACACTTA | Intron 1 | 60 | 136576 | 136595 | 684 |
| 532383 | AGGCTTCATGTGAGGTAACA | Intron 1 | 58 | 136996 | 137015 | 685 |
| 532384 | TGAAAGCTTAGTACAAGAAG | Intron 1 | 51 | 138048 | 138067 | 686 |
| 532385 | CTCTCCTCTTGGAGATCCAG | Intron 1 | 58 | 138782 | 138801 | 687 |
| 532386 | GCTGAGATTTCTCTCCTCTT | Intron 1 | 78 | 138792 | 138811 | 688 |

TABLE 132-continued

Inhibition of GHR mRNA by 5-10-5 MOE gapmers targeting introns 1 and 2 of SEQ ID NO: 2

| ISIS NO | Sequence | Target Region | % inhibition | SEQ ID NO: 2 Start Site | SEQ ID NO: 2 Stop Site | SEQ ID NO |
|---|---|---|---|---|---|---|
| 532387 | CTTTTGCTGAGATTTCTCTC | Intron 1 | 58 | 138797 | 138816 | 689 |
| 532388 | GAACATATGTCCATAGAATG | Intron 1 | 57 | 141700 | 141719 | 690 |
| 532389 | GAACAGGCTATGTAATCAAA | Intron 1 | 68 | 143021 | 143040 | 691 |
| 532390 | TTTTTATTACTGTGCAAACC | Intron 1 | 41 | 143878 | 143897 | 692 |
| 532391 | ACTGAGGGTGGAAATGGAAA | Intron 2 | 23 | 145059 | 145078 | 693 |
| 532392 | ATGCCATACTTTTCATTTCA | Intron 2 | 87 | 146351 | 146370 | 694 |
| 532393 | TCTTTAAAGATTTCCTATGC | Intron 2 | 66 | 146367 | 146386 | 695 |
| 532394 | TCACAATTAAATTATGTTTA | Intron 2 | 47 | 149858 | 149877 | 696 |
| 532395 | TTTGCCATCACCAAACACCA | Intron 2 | 94 | 150972 | 150991 | 697 |
| 532396 | TCAGAATGCTGAAGGATGGG | Intron 2 | 70 | 152208 | 152227 | 698 |
| 532397 | ACAATTGCAGGAGAGAACTG | Intron 2 | 57 | 152296 | 152315 | 699 |
| 532398 | GTTCAGTCACCTGGAAAGAG | Intron 2 | 62 | 152549 | 152568 | 700 |
| 532399 | CGGAGTTCAGTCACCTGGAA | Intron 2 | 77 | 152553 | 152572 | 701 |
| 532400 | AATCTAAAGTTCAATGTCCA | Intron 2 | 77 | 152752 | 152771 | 702 |
| 532401 | CCACCTTTGGGTGAATAGCA | Intron 2 | 95 | 153921 | 153940 | 703 |
| 532402 | CAACATCAAAAGTTTCCACC | Intron 2 | 81 | 153936 | 153955 | 704 |
| 532403 | AAGCTTCTATCAACCAACTG | Intron 2 | 87 | 154093 | 154112 | 705 |
| 532404 | ACCATTTTCTAATAATTCAC | Intron 2 | 46 | 154502 | 154521 | 706 |
| 532405 | ACCTGCACTTGGACAACTGA | Intron 2 | 60 | 154727 | 154746 | 707 |
| 532406 | GTCAGTGCTTTGGTGATGTA | Intron 2 | 11 | 155283 | 155302 | 708 |
| 532407 | TAGAAGCACAGGAACTAGAG | Intron 2 | 68 | 155889 | 155908 | 709 |
| 532408 | TTTAATTTTATTAGAAGCAC | Intron 2 | 14 | 155900 | 155919 | 710 |
| 532409 | GAGCAAGAATTAAGAAAATC | Intron 2 | 29 | 155973 | 155992 | 711 |
| 532410 | CTCTGCAGTCATGTACACAA | Intron 2 | 93 | 156594 | 156613 | 712 |
| 532411 | GCTTGGTTTGTCAATCCTTT | Intron 2 | 95 | 156889 | 156908 | 713 |
| 532412 | GTTCTCAAGCAGGAGCCATT | Intron 2 | 70 | 157330 | 157349 | 714 |
| 532413 | AGGGTGATCTTCCAAAACAA | Intron 2 | 87 | 158612 | 158631 | 715 |
| 532414 | TCTCCTATGCTTCCTTTAAT | Intron 2 | 25 | 158813 | 158832 | 716 |
| 532415 | GACATAAATATGTTCACTGA | Intron 2 | 81 | 159216 | 159235 | 717 |
| 532416 | TTACTGAGTGACAGTACAGT | Intron 2 | 65 | 161588 | 161607 | 718 |
| 532417 | CCAGGCACCAGCACAGGCAC | Intron 2 | 47 | 161950 | 161969 | 719 |
| 532418 | TTAATGTCAGTAGAAAGCTG | Intron 2 | 0 | 162349 | 162368 | 720 |
| 532419 | GCAGGTGGAAAGAAGATGTC | Intron 2 | 50 | 162531 | 162550 | 721 |
| 532420 | GCCAGGGTCTTTACAAAGTT | Intron 2 | 93 | 162751 | 162770 | 722 |
| 532421 | CATTACCTTTGTACATGTAC | Intron 2 | 83 | 164839 | 164858 | 723 |

TABLE 132-continued

Inhibition of GHR mRNA by 5-10-5 MOE gapmers targeting introns 1 and 2 of SEQ ID NO: 2

| ISIS NO | Sequence | Target Region | % inhibition | SEQ ID NO: 2 Start Site | SEQ ID NO: 2 Stop Site | SEQ ID NO |
|---|---|---|---|---|---|---|
| 532422 | GAAGCAACTTCTCTGAGGTC | Intron 2 | 68 | 165040 | 165059 | 724 |
| 532423 | GCCTGGCAAGAAGGGCCCTT | Intron 2 | 56 | 165856 | 165875 | 725 |
| 532424 | ACACATGTTTTTAAATTTAT | Intron 2 | 21 | 166241 | 166260 | 726 |
| 532425 | TCACAATGCACTAAAAGAAA | Intron 2 | 53 | 168760 | 168779 | 727 |
| 532426 | TCCCAATGACTTACTGTAGA | Intron 2 | 78 | 169073 | 169092 | 728 |
| 532427 | TAAGCATTTATGGAGGAATG | Intron 2 | 46 | 169134 | 169153 | 729 |
| 532428 | TGAGGTGGGTGGCCAACAGG | Intron 2 | 66 | 170081 | 170100 | 730 |
| 532429 | GTTTTTCATTTTGATTGCAG | Intron 2 | 88 | 170158 | 170177 | 731 |
| 532430 | AGCTCAAGTGTTTTTCATTT | Intron 2 | 64 | 170167 | 170186 | 732 |
| 532431 | CAATGTCACAGCTGTTTCCT | Intron 2 | 62 | 170272 | 170291 | 733 |
| 532432 | GAACTTTGGAGGCTTTTAGA | Intron 2 | 55 | 170703 | 170722 | 734 |
| 532433 | TGTATGCCCCAAACTCCCAT | Intron 2 | 83 | 171431 | 171450 | 735 |
| 532434 | ACACAAATAAGGGAATAATA | Intron 2 | 24 | 171549 | 171568 | 736 |
| 532435 | TAGTTCAGCCACTATGGAAA | Intron 2 | 47 | 171926 | 171945 | 737 |
| 532436 | CTCCAAATTCCAGTCCTAGG | Intron 2 | 93 | 172746 | 172765 | 738 |
| 532437 | AGTTGGCACTGCTATATCAG | Intron 2 | 66 | 173668 | 173687 | 739 |
| 532438 | GGCCTTAGATTGTAAGTTTT | Intron 2 | 69 | 174122 | 174141 | 740 |
| 532439 | TTTTAGTATTATTGTAGGAA | Intron 2 | 16 | 174188 | 174207 | 741 |
| 532440 | TTTCATTAATGAAACCTGAT | Intron 2 | 39 | 174812 | 174831 | 742 |
| 532441 | CCCTCAGCTGCCTCTTCAAT | Intron 2 | 51 | 175014 | 175033 | 743 |
| 532442 | TATTGTATCCTGGCCCCTAA | Intron 2 | 68 | 175689 | 175708 | 744 |
| 532443 | AGAACAAGAGCCTAGAAGTA | Intron 2 | 35 | 176592 | 176611 | 745 |
| 532444 | GTGACTATGTCACTGAATTT | Intron 2 | 14 | 176918 | 176937 | 746 |
| 532445 | GCCCTACCCAGCAGCCTGTG | Intron 2 | 79 | 177540 | 177559 | 747 |
| 532446 | CAAACATAAAGAGAGTTCCA | Intron 2 | 79 | 177811 | 177830 | 748 |
| 532447 | CTTTAAATGAAGTAGAGCTC | Intron 2 | 0 | 178090 | 178109 | 749 |
| 532448 | CTGTTCAAAGAATGCAGGCC | Intron 2 | 70 | 178905 | 178924 | 750 |
| 532449 | GTCTAGCCTAACAGAGATAT | Intron 2 | 47 | 179137 | 179156 | 751 |
| 532450 | AAAGAGTGATGTCTAGCCTA | Intron 2 | 55 | 179147 | 179166 | 752 |
| 532451 | CACTTCTTACTCCTTTGAGG | Intron 2 | 50 | 179631 | 179650 | 753 |
| 532452 | TTCCACAAGAAACTCAGTTT | Intron 2 | 56 | 181514 | 181533 | 754 |
| 532453 | AGAAATGCCAAAGATAGCTC | Intron 2 | 56 | 182105 | 182124 | 755 |

TABLE 133

Inhibition of GHR mRNA by 5-10-5 MOE gapmers targeting intron 2 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 533249 | AGCAGAGGATCTCAGCTGCA | 84 | 146241 | 146260 | 756 |
| 533250 | AATCCCTGCTCAAGTGCTAC | 75 | 147259 | 147278 | 757 |
| 533251 | AAATCCCTGCTCAAGTGCTA | 71 | 147260 | 147279 | 758 |
| 533252 | AAAATCCCTGCTCAAGTGCT | 73 | 147261 | 147280 | 759 |
| 533253 | AGAAAATCCCTGCTCAAGTG | 56 | 147263 | 147282 | 760 |
| 533254 | AAGAAAATCCCTGCTCAAGT | 58 | 147264 | 147283 | 761 |
| 533255 | CAAGAAAATCCCTGCTCAAG | 46 | 147265 | 147284 | 762 |
| 533256 | CTGATATTGTAATTCTTGGT | 91 | 148059 | 148078 | 763 |
| 533257 | CCTGATATTGTAATTCTTGG | 90 | 148060 | 148079 | 764 |
| 533258 | GCCTGATATTGTAATTCTTG | 94 | 148061 | 148080 | 765 |
| 533259 | ATGCCTGATATTGTAATTCT | 91 | 148063 | 148082 | 766 |
| 533260 | AATGCCTGATATTGTAATTC | 74 | 148064 | 148083 | 767 |
| 533261 | CAATGCCTGATATTGTAATT | 76 | 148065 | 148084 | 768 |
| 533262 | AATTATGTGCTTTGCCTGCA | 92 | 148904 | 148923 | 769 |
| 533263 | CAATTATGTGCTTTGCCTGC | 83 | 148905 | 148924 | 770 |
| 533264 | TCAATTATGTGCTTTGCCTG | 83 | 148906 | 148925 | 771 |
| 533265 | TGTCAATTATGTGCTTTGCC | 91 | 148908 | 148927 | 772 |
| 533266 | ATGTCAATTATGTGCTTTGC | 83 | 148909 | 148928 | 773 |
| 533267 | GATGTCAATTATGTGCTTTG | 74 | 148910 | 148929 | 774 |
| 533268 | CTGGTGACTCTGCCTGATGA | 77 | 151385 | 151404 | 775 |
| 533269 | GCTGGTGACTCTGCCTGATG | 87 | 151386 | 151405 | 776 |
| 533270 | TGCTGGTGACTCTGCCTGAT | 89 | 151387 | 151406 | 777 |
| 533271 | GCTGCTGGTGACTCTGCCTG | 94 | 151389 | 151408 | 778 |
| 533272 | GGCTGCTGGTGACTCTGCCT | 77 | 151390 | 151409 | 779 |
| 533273 | TGGCTGCTGGTGACTCTGCC | 82 | 151391 | 151410 | 780 |
| 533274 | GCTGAAGGATGGGCATCCAG | 85 | 152201 | 152220 | 781 |
| 533275 | TGCTGAAGGATGGGCATCCA | 85 | 152202 | 152221 | 782 |
| 533276 | ATGCTGAAGGATGGGCATCC | 78 | 152203 | 152222 | 783 |
| 533277 | GAATGCTGAAGGATGGGCAT | 66 | 152205 | 152224 | 784 |
| 533278 | AGAATGCTGAAGGATGGGCA | 81 | 152206 | 152225 | 785 |
| 533279 | CAGAATGCTGAAGGATGGGC | 85 | 152207 | 152226 | 786 |
| 533280 | TCCAGTAGTCAATATTATTT | 87 | 153001 | 153020 | 787 |
| 533281 | ATCCAGTAGTCAATATTATT | 85 | 153002 | 153021 | 788 |
| 533282 | TATCCAGTAGTCAATATTAT | 69 | 153003 | 153022 | 789 |
| 533283 | GTTATCCAGTAGTCAATATT | 77 | 153005 | 153024 | 790 |
| 533284 | GGTTATCCAGTAGTCAATAT | 85 | 153006 | 153025 | 791 |

TABLE 133-continued

Inhibition of GHR mRNA by 5-10-5 MOE gapmers targeting intron 2 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 533285 | TGGTTATCCAGTAGTCAATA | 86 | 153007 | 153026 | 792 |
| 533286 | CAACTTGAGGACAATAAGAG | 35 | 155591 | 155610 | 793 |
| 533287 | TCAACTTGAGGACAATAAGA | 62 | 155592 | 155611 | 794 |
| 533288 | CTCAACTTGAGGACAATAAG | 86 | 155593 | 155612 | 795 |
| 533289 | AACTCAACTTGAGGACAATA | 82 | 155595 | 155614 | 796 |
| 533290 | TAACTCAACTTGAGGACAAT | 66 | 155596 | 155615 | 797 |
| 533291 | ATAACTCAACTTGAGGACAA | 87 | 155597 | 155616 | 798 |
| 533292 | CAGGAAGAAAGGAACCTTAG | 77 | 156391 | 156410 | 799 |
| 533293 | CCAGGAAGAAAGGAACCTTA | 84 | 156392 | 156411 | 800 |
| 533294 | ACCAGGAAGAAAGGAACCTT | 86 | 156393 | 156412 | 801 |
| 533295 | AGACCAGGAAGAAAGGAACC | 74 | 156395 | 156414 | 802 |
| 533296 | TAGACCAGGAAGAAAGGAAC | 59 | 156396 | 156415 | 803 |
| 533297 | ATAGACCAGGAAGAAAGGAA | 65 | 156397 | 156416 | 804 |
| 533298 | TACAATGCACAGGACACGCC | 73 | 157198 | 157217 | 805 |
| 533299 | CTACAATGCACAGGACACGC | 85 | 157199 | 157218 | 806 |
| 533300 | GCTACAATGCACAGGACACG | 83 | 157200 | 157219 | 807 |
| 533301 | ATGCTACAATGCACAGGACA | 89 | 157202 | 157221 | 808 |
| 533302 | TATGCTACAATGCACAGGAC | 82 | 157203 | 157222 | 809 |
| 533303 | ATATGCTACAATGCACAGGA | 84 | 157204 | 157223 | 810 |
| 533304 | CTGATATTTATTGCTGTACG | 76 | 158006 | 158025 | 811 |
| 533305 | CTCTGATATTTATTGCTGTA | 80 | 158008 | 158027 | 812 |
| 533306 | TCTCTGATATTTATTGCTGT | 86 | 158009 | 158028 | 813 |
| 533307 | GTCTCTGATATTTATTGCTG | 80 | 158010 | 158029 | 814 |
| 533308 | CCAGAAGAATTACCCATGCA | 85 | 165550 | 165569 | 815 |
| 533309 | TCCAGAAGAATTACCCATGC | 84 | 165551 | 165570 | 816 |
| 533310 | TTCCAGAAGAATTACCCATG | 81 | 165552 | 165571 | 817 |
| 533311 | TCTTCCAGAAGAATTACCCA | 58 | 165554 | 165573 | 818 |
| 533312 | ATCTTCCAGAAGAATTACCC | 64 | 165555 | 165574 | 819 |
| 533313 | CATCTTCCAGAAGAATTACC | 58 | 165556 | 165575 | 820 |
| 533314 | TTTCTGCAGTATCCTAGCCT | 78 | 166350 | 166369 | 821 |
| 533315 | GTTTCTGCAGTATCCTAGCC | 88 | 166351 | 166370 | 822 |
| 533316 | AGTTTCTGCAGTATCCTAGC | 86 | 166352 | 166371 | 823 |
| 533317 | TCAGTTTCTGCAGTATCCTA | 88 | 166354 | 166373 | 824 |
| 533318 | TTCAGTTTCTGCAGTATCCT | 87 | 166355 | 166374 | 825 |
| 533319 | TTTCAGTTTCTGCAGTATCC | 80 | 166356 | 166375 | 826 |

TABLE 133-continued

Inhibition of GHR mRNA by 5-10-5 MOE gapmers targeting intron 2 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 533320 | GTTTCCATTTTCTTGATTCC | 70 | 169601 | 169620 | 827 |
| 533321 | TGTTTCCATTTTCTTGATTC | 54 | 169602 | 169621 | 828 |
| 533322 | GTGTTTCCATTTTCTTGATT | 55 | 169603 | 169622 | 829 |
| 533323 | TGGTGTTTCCATTTTCTTGA | 73 | 169605 | 169624 | 830 |
| 533324 | ATGGTGTTTCCATTTTCTTG | 76 | 169606 | 169625 | 831 |
| 533325 | AATGGTGTTTCCATTTTCTT | 78 | 169607 | 169626 | 832 |

TABLE 134

Inhibition of GHR mRNA by 5-10-5 MOE gapmers targeting introns 2 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 533326 | AACCCATTTCATCCATTTAA | Intron 2 | 93 | 175369 | 175388 | 833 |
| 533327 | GAACCCATTTCATCCATTTA | Intron 2 | 83 | 175370 | 175389 | 834 |
| 533328 | GGAACCCATTTCATCCATTT | Intron 2 | 92 | 175371 | 175390 | 835 |
| 533329 | TAGGAACCCATTTCATCCAT | Intron 2 | 91 | 175373 | 175392 | 836 |
| 533330 | GTAGGAACCCATTTCATCCA | Intron 2 | 95 | 175374 | 175393 | 837 |
| 533331 | GGTAGGAACCCATTTCATCC | Intron 2 | 92 | 175375 | 175394 | 838 |
| 533332 | TGAGGGATTGCCTCAGTAGC | Intron 2 | 66 | 179616 | 179635 | 839 |
| 533333 | TTGAGGGATTGCCTCAGTAG | Intron 2 | 72 | 179617 | 179636 | 840 |
| 533334 | TTTGAGGGATTGCCTCAGTA | Intron 2 | 67 | 179618 | 179637 | 841 |
| 533335 | CCTTTGAGGGATTGCCTCAG | Intron 2 | 74 | 179620 | 179639 | 842 |
| 533336 | TCCTTTGAGGGATTGCCTCA | Intron 2 | 66 | 179621 | 179640 | 843 |
| 533337 | CTCCTTTGAGGGATTGCCTC | Intron 2 | 76 | 179622 | 179641 | 844 |
| 533338 | AACTTAGGACTTGGGACATT | Intron 2 | 64 | 184575 | 184594 | 845 |
| 533339 | TAACTTAGGACTTGGGACAT | Intron 2 | 54 | 184576 | 184595 | 846 |
| 533340 | CTAACTTAGGACTTGGGACA | Intron 2 | 63 | 184577 | 184596 | 847 |
| 533341 | CACTAACTTAGGACTTGGGA | Intron 2 | 82 | 184579 | 184598 | 848 |
| 533342 | TCACTAACTTAGGACTTGGG | Intron 2 | 77 | 184580 | 184599 | 849 |
| 533343 | GTCACTAACTTAGGACTTGG | Intron 2 | 83 | 184581 | 184600 | 850 |
| 533344 | TGGGCTAGATCAGGATTGGT | Intron 2 | 81 | 188617 | 188636 | 851 |
| 533345 | ATGGGCTAGATCAGGATTGG | Intron 2 | 70 | 188618 | 188637 | 852 |
| 533346 | CATGGGCTAGATCAGGATTG | Intron 2 | 64 | 188619 | 188638 | 853 |
| 533347 | ACCATGGGCTAGATCAGGAT | Intron 2 | 82 | 188621 | 188640 | 854 |
| 533348 | TACCATGGGCTAGATCAGGA | Intron 2 | 88 | 188622 | 188641 | 855 |

TABLE 134-continued

Inhibition of GHR mRNA by 5-10-5 MOE gapmers targeting introns 2 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 533349 | CTACCATGGGCTAGATCAGG | Intron 2 | 87 | 188623 | 188642 | 856 |
| 533350 | ATGAGCTTAGCAGTCACTTA | Intron 2 | 83 | 189482 | 189501 | 857 |
| 533351 | CATGAGCTTAGCAGTCACTT | Intron 2 | 87 | 189483 | 189502 | 858 |
| 533352 | CCATGAGCTTAGCAGTCACT | Intron 2 | 92 | 189484 | 189503 | 859 |
| 533353 | GTCTCAGCAAACCTGGGATA | Intron 2 | 84 | 190283 | 190302 | 860 |
| 533354 | TGTCTCAGCAAACCTGGGAT | Intron 2 | 82 | 190284 | 190303 | 861 |
| 533355 | ATGTCTCAGCAAACCTGGGA | Intron 2 | 81 | 190285 | 190304 | 862 |
| 533356 | GAATGTCTCAGCAAACCTGG | Intron 2 | 76 | 190287 | 190306 | 863 |
| 533357 | GGAATGTCTCAGCAAACCTG | Intron 2 | 82 | 190288 | 190307 | 864 |
| 533358 | AGGAATGTCTCAGCAAACCT | Intron 2 | 85 | 190289 | 190308 | 865 |
| 533359 | TACAGACATAGCTCTAACCT | Intron 2 | 79 | 191139 | 191158 | 866 |
| 533360 | ATACAGACATAGCTCTAACC | Intron 2 | 79 | 191140 | 191159 | 867 |
| 533361 | GATACAGACATAGCTCTAAC | Intron 2 | 71 | 191141 | 191160 | 868 |
| 533362 | TGGATACAGACATAGCTCTA | Intron 2 | 79 | 191143 | 191162 | 869 |
| 533363 | CTGGATACAGACATAGCTCT | Intron 2 | 82 | 191144 | 191163 | 870 |
| 533364 | GCTGGATACAGACATAGCTC | Intron 2 | 95 | 191145 | 191164 | 871 |
| 533365 | ACACTGTTTGTGAGGGTCAA | Intron 2 | 87 | 191939 | 191958 | 872 |
| 533366 | AACACTGTTTGTGAGGGTCA | Intron 2 | 81 | 191940 | 191959 | 873 |
| 533367 | CAACACTGTTTGTGAGGGTC | Intron 2 | 85 | 191941 | 191960 | 874 |
| 533368 | AACAACACTGTTTGTGAGGG | Intron 2 | 65 | 191943 | 191962 | 875 |
| 533369 | AAACAACACTGTTTGTGAGG | Intron 2 | 76 | 191944 | 191963 | 876 |
| 533370 | CAAACAACACTGTTTGTGAG | Intron 2 | 67 | 191945 | 191964 | 877 |
| 533371 | TTCAAGTTTAGGATCTGCAG | Intron 2 | 73 | 196536 | 196555 | 878 |
| 533372 | CTTCAAGTTTAGGATCTGCA | Intron 2 | 88 | 196537 | 196556 | 879 |
| 533373 | GCTTCAAGTTTAGGATCTGC | Intron 2 | 86 | 196538 | 196557 | 880 |
| 533374 | GGGCTTCAAGTTTAGGATCT | Intron 2 | 67 | 196540 | 196559 | 881 |
| 533375 | AGGGCTTCAAGTTTAGGATC | Intron 2 | 66 | 196541 | 196560 | 882 |
| 533376 | CAGGGCTTCAAGTTTAGGAT | Intron 2 | 74 | 196542 | 196561 | 883 |
| 533377 | TGTGGCTTTAATTCACTAAT | Intron 2 | 84 | 198145 | 198164 | 884 |
| 533378 | ATGTGGCTTTAATTCACTAA | Intron 2 | 86 | 198146 | 198165 | 885 |
| 533379 | TATGTGGCTTTAATTCACTA | Intron 2 | 79 | 198147 | 198166 | 886 |
| 533380 | GGTATGTGGCTTTAATTCAC | Intron 2 | 83 | 198149 | 198168 | 887 |
| 533381 | TGGTATGTGGCTTTAATTCA | Intron 2 | 81 | 198150 | 198169 | 888 |
| 533382 | GTGGTATGTGGCTTTAATTC | Intron 2 | 86 | 198151 | 198170 | 889 |
| 533383 | TCTGTGTTCAGTTGCATCAC | Intron 2 | 75 | 199817 | 199836 | 890 |

TABLE 134-continued

Inhibition of GHR mRNA by 5-10-5 MOE gapmers targeting introns 2 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 533384 | TTCTGTGTTCAGTTGCATCA | Intron 2 | 82 | 199818 | 199837 | 891 |
| 533385 | GTTCTGTGTTCAGTTGCATC | Intron 2 | 86 | 199819 | 199838 | 892 |
| 533386 | GTACTCATGAGGAGGCACTT | Intron 2 | 81 | 201413 | 201432 | 893 |
| 533387 | GGTACTCATGAGGAGGCACT | Intron 2 | 82 | 201414 | 201433 | 894 |
| 533388 | TGGTACTCATGAGGAGGCAC | Intron 2 | 78 | 201415 | 201434 | 895 |
| 533389 | ATTGGTACTCATGAGGAGGC | Intron 2 | 64 | 201417 | 201436 | 896 |
| 533390 | AATTGGTACTCATGAGGAGG | Intron 2 | 47 | 201418 | 201437 | 897 |
| 533391 | CAATTGGTACTCATGAGGAG | Intron 2 | 54 | 201419 | 201438 | 898 |
| 533392 | AAACTCTGCAACTCCAACCC | Intron 2 | 69 | 205549 | 205568 | 899 |
| 533393 | GAAACTCTGCAACTCCAACC | Intron 2 | 64 | 205550 | 205569 | 900 |
| 533394 | GGAAACTCTGCAACTCCAAC | Intron 2 | 83 | 205551 | 205570 | 901 |
| 533395 | ATGGAAACTCTGCAACTCCA | Intron 2 | 88 | 205553 | 205572 | 902 |
| 533396 | CATGGAAACTCTGCAACTCC | Intron 2 | 70 | 205554 | 205573 | 903 |
| 533397 | TCATGGAAACTCTGCAACTC | Intron 2 | 69 | 205555 | 205574 | 904 |
| 533398 | ACATCTGGATGTGAGGCTCG | Intron 3 | 64 | 210559 | 210578 | 905 |
| 533399 | CACATCTGGATGTGAGGCTC | Intron 3 | 84 | 210560 | 210579 | 906 |
| 533400 | GTCACATCTGGATGTGAGGC | Intron 3 | 75 | 210562 | 210581 | 907 |
| 533401 | TGTCACATCTGGATGTGAGG | Intron 3 | 51 | 210563 | 210582 | 908 |
| 533402 | CTGTCACATCTGGATGTGAG | Intron 3 | 30 | 210564 | 210583 | 909 |

TABLE 135

Inhibition of GHR mRNA by 5-10-5 MOE gapmers targeting introns 2 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 523715 | GTCAATTATGTGCTTTGCCT | Intron 2 | 91 | 148907 | 148926 | 910 |
| 523716 | ACATTCAAAATTCTTCCTTG | Intron 2 | 50 | 149787 | 149806 | 911 |
| 523717 | ATCCTGCATATATTTTATTG | Intron 2 | 20 | 150588 | 150607 | 912 |
| 523718 | CTGCTGGTGACTCTGCCTGA | Intron 2 | 77 | 151388 | 151407 | 913 |
| 523719 | AATGCTGAAGGATGGGCATC | Intron 2 | 66 | 152204 | 152223 | 914 |
| 523720 | TTATCCAGTAGTCAATATTA | Intron 2 | 71 | 153004 | 153023 | 915 |
| 523721 | TCTCATGTTAAAGTTCTTAA | Intron 2 | 48 | 153831 | 153850 | 916 |
| 523722 | TGCACTTGGACAACTGATAG | Intron 2 | 29 | 154724 | 154743 | 917 |
| 523723 | ACTCAACTTGAGGACAATAA | Intron 2 | 88 | 155594 | 155613 | 918 |
| 523724 | GACCAGGAAGAAAGGAACCT | Intron 2 | 72 | 156394 | 156413 | 919 |

TABLE 135-continued

Inhibition of GHR mRNA by 5-10-5 MOE gapmers targeting introns 2 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 523725 | TGCTACAATGCACAGGACAC | Intron 2 | 80 | 157201 | 157220 | 920 |
| 523726 | TCTGATATTTATTGCTGTAC | Intron 2 | 73 | 158007 | 158026 | 921 |
| 523727 | ATGCTTCCTTTAATAAATGT | Intron 2 | 0 | 158807 | 158826 | 922 |
| 523728 | AACATTTAGAACCTAGGAGA | Intron 2 | 20 | 159610 | 159629 | 923 |
| 523729 | CAAGCTTGCAAGTAGGAAAA | Intron 2 | 51 | 160410 | 160429 | 924 |
| 523730 | CCAGGCTGTTCATGCCAAGG | Intron 2 | 26 | 161248 | 161267 | 925 |
| 523731 | CCTGCCAAGGGCAAGCCAGG | Intron 2 | 17 | 162064 | 162083 | 926 |
| 523732 | TTTCACCTGGTGACTGGAAG | Intron 2 | 51 | 163019 | 163038 | 927 |
| 523733 | ATTTTCTACCATCAAAGAGA | Intron 2 | 4 | 163943 | 163962 | 928 |
| 523734 | GATTAAGTTTTCTTTAAAAA | Intron 2 | 0 | 164746 | 164765 | 929 |
| 523735 | CTTCCAGAAGAATTACCCAT | Intron 2 | 56 | 165553 | 165572 | 930 |
| 523736 | CAGTTTCTGCAGTATCCTAG | Intron 2 | 77 | 166353 | 166372 | 931 |
| 523737 | TATTTTGAAAATGAGATTCA | Intron 2 | 0 | 167195 | 167214 | 932 |
| 523738 | GTGGCCCGAGTAAAGATAAA | Intron 2 | 21 | 167995 | 168014 | 933 |
| 523739 | CCTGTCAATCCTCTTATATG | Intron 2 | 37 | 168804 | 168823 | 934 |
| 523740 | GGTGTTTCCATTTTCTTGAT | Intron 2 | 65 | 169604 | 169623 | 935 |
| 523741 | ACAGGGTCAAAAGTTCACTT | Intron 2 | 44 | 170407 | 170426 | 936 |
| 523742 | TAGGAAAGCTGAGAGAATCC | Intron 2 | 35 | 171207 | 171226 | 937 |
| 523743 | AGCATATGAAAAAATACTCA | Intron 2 | 0 | 172101 | 172120 | 938 |
| 523744 | CTTCAGAAATCAGCATCTGA | Intron 2 | 45 | 172937 | 172956 | 939 |
| 523745 | TTACAAGTGACAGTGTTTGT | Intron 2 | 28 | 173737 | 173756 | 940 |
| 523746 | ATCAGACCCTGAAGAATTTA | Intron 2 | 29 | 174560 | 174579 | 941 |
| 523747 | AGGAACCCATTTCATCCATT | Intron 2 | 83 | 175372 | 175391 | 942 |
| 523748 | CACATTGGTAACTTAAAGTT | Intron 2 | 18 | 176263 | 176282 | 943 |
| 523749 | TATTATCTGACTCATTTCTG | Intron 2 | 16 | 177072 | 177091 | 944 |
| 523750 | AAATAAGACAAAGAAAATTC | Intron 2 | 0 | 177872 | 177891 | 945 |
| 523751 | TTTTAAAAATAACCAATTCA | Intron 2 | 0 | 178788 | 178807 | 946 |
| 523752 | CTTTGAGGGATTGCCTCAGT | Intron 2 | 66 | 179619 | 179638 | 947 |
| 523753 | ACAGTCCTCATGAACAGATT | Intron 2 | 37 | 180513 | 180532 | 948 |
| 523754 | ACTATCATTAATAATATTGT | Intron 2 | 0 | 181323 | 181342 | 949 |
| 523755 | ATCTAGATTTGCCTTATAAG | Intron 2 | 27 | 182123 | 182142 | 950 |
| 523756 | TGGTTGAGGAAGACAGTCTC | Intron 2 | 16 | 182962 | 182981 | 951 |
| 523757 | TGGCTCATAACTTCCTTAGC | Intron 2 | 43 | 183762 | 183781 | 952 |
| 523758 | ACTAACTTAGGACTTGGGAC | Intron 2 | 72 | 184578 | 184597 | 953 |
| 523759 | CTTATAGCATTACTAAGTGG | Intron 2 | 49 | 185403 | 185422 | 954 |

TABLE 135-continued

Inhibition of GHR mRNA by 5-10-5 MOE gapmers targeting introns 2 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 523760 | TGGTGGCAGGAGAGAGGGAA | Intron 2 | 48 | 186203 | 186222 | 955 |
| 523761 | TTTGCCAGGAAATCTTGAAA | Intron 2 | 35 | 187003 | 187022 | 956 |
| 523762 | ATAACTTTTCTCTGAAATTT | Intron 2 | 8 | 187803 | 187822 | 957 |
| 523763 | CCATGGGCTAGATCAGGATT | Intron 2 | 59 | 188620 | 188639 | 958 |
| 523764 | TGAGCTTAGCAGTCACTTAG | Intron 2 | 62 | 189481 | 189500 | 959 |
| 523765 | AATGTCTCAGCAAACCTGGG | Intron 2 | 62 | 190286 | 190305 | 960 |
| 523766 | GGATACAGACATAGCTCTAA | Intron 2 | 75 | 191142 | 191161 | 961 |
| 523767 | ACAACACTGTTTGTGAGGGT | Intron 2 | 66 | 191942 | 191961 | 962 |
| 523768 | TCTATTTTCTAATAGCTGTT | Intron 2 | 49 | 192742 | 192761 | 963 |
| 523769 | GGCCCCACCTCTGACCTTCA | Intron 2 | 7 | 193542 | 193561 | 964 |
| 523770 | TGGTAAAGCTAGAAAAAAAA | Intron 2 | 0 | 194346 | 194365 | 965 |
| 523771 | AAGTGGTAAATATGATCACA | Intron 2 | 23 | 195159 | 195178 | 966 |
| 523772 | GGCTTCAAGTTTAGGATCTG | Intron 2 | 52 | 196539 | 196558 | 967 |
| 523773 | TTGTTGACACTCTCTTTTGG | Intron 2 | 18 | 197348 | 197367 | 968 |
| 523774 | GTATGTGGCTTTAATTCACT | Intron 2 | 71 | 198148 | 198167 | 969 |
| 523775 | AATTAGTTGTTTTGGCAAAT | Intron 2 | 14 | 198988 | 199007 | 970 |
| 523776 | CTGTGTTCAGTTGCATCACG | Intron 2 | 75 | 199816 | 199835 | 971 |
| 523777 | AATGTGGAAGTTTCCTAACA | Intron 2 | 15 | 200616 | 200635 | 972 |
| 523778 | TTGGTACTCATGAGGAGGCA | Intron 2 | 58 | 201416 | 201435 | 973 |
| 523779 | TTTCTCTGTGTTTAAAATTG | Intron 2 | 13 | 202308 | 202327 | 974 |
| 523780 | GTAAAGCACAATGAACAAAA | Intron 2 | 21 | 203115 | 203134 | 975 |
| 523781 | ATCACAGATCTTTGCTACAA | Intron 2 | 51 | 203915 | 203934 | 976 |
| 523782 | TCCTGCCTTTCTGAACCAAA | Intron 2 | 50 | 204721 | 204740 | 977 |
| 523783 | TGGAAACTCTGCAACTCCAA | Intron 2 | 58 | 205552 | 205571 | 978 |
| 523784 | ACACAGTAGGGAACAATTTT | Intron 2 | 8 | 206412 | 206431 | 979 |
| 523785 | AGACAGATGGTGAAATGATG | Intron 2 | 0 | 207219 | 207238 | 980 |
| 523786 | AAACAGAAAGAGAAGAAAAC | Intron 2 | 0 | 208117 | 208136 | 981 |
| 523787 | CTTAGATAAATACTTCAAGA | Intron 3 | 0 | 208938 | 208957 | 982 |
| 523788 | AGCCACTTCTTTTACAACCT | Intron 3 | 0 | 209742 | 209761 | 983 |
| 523789 | TCACATCTGGATGTGAGGCT | Intron 3 | 80 | 210561 | 210580 | 984 |
| 523790 | GACTGAAACTTAAAGGTGGG | Intron 3 | 7 | 211399 | 211418 | 985 |
| 523791 | AAAGATGTGCAATCATCTAA | Intron 3 | 44 | 212204 | 212223 | 986 |

TABLE 136

Inhibition of GHR mRNA by 3-10-4 MOE gapmers targeting introns 2 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 539360 | GCTGGTGACTCTGCCTG | Intron 2 | 95 | 151389 | 151405 | 987 |
| 539361 | TGCTGGTGACTCTGCCT | Intron 2 | 95 | 151390 | 151406 | 988 |
| 539362 | CTGCTGGTGACTCTGCC | Intron 2 | 93 | 151391 | 151407 | 989 |
| 539363 | AGTAGTCAATATTATTT | Intron 2 | 31 | 153001 | 153017 | 990 |
| 539364 | CAGTAGTCAATATTATT | Intron 2 | 13 | 153002 | 153018 | 991 |
| 539365 | CCAGTAGTCAATATTAT | Intron 2 | 34 | 153003 | 153019 | 992 |
| 539366 | CCTTTGGGTGAATAGCA | Intron 2 | 64 | 153921 | 153937 | 993 |
| 539367 | ACCTTTGGGTGAATAGC | Intron 2 | 78 | 153922 | 153938 | 994 |
| 539368 | CACCTTTGGGTGAATAG | Intron 2 | 40 | 153923 | 153939 | 995 |
| 539369 | CAACTTGAGGACAATAA | Intron 2 | 38 | 155594 | 155610 | 996 |
| 539370 | TCAACTTGAGGACAATA | Intron 2 | 63 | 155595 | 155611 | 997 |
| 539371 | CTCAACTTGAGGACAAT | Intron 2 | 81 | 155596 | 155612 | 998 |
| 539372 | CAGGAAGAAAGGAACCT | Intron 2 | 70 | 156394 | 156410 | 999 |
| 539373 | CCAGGAAGAAAGGAACC | Intron 2 | 59 | 156395 | 156411 | 1000 |
| 539374 | ACCAGGAAGAAAGGAAC | Intron 2 | 43 | 156396 | 156412 | 1001 |
| 539375 | TGCAGTCATGTACACAA | Intron 2 | 93 | 156594 | 156610 | 1002 |
| 539376 | CTGCAGTCATGTACACA | Intron 2 | 91 | 156595 | 156611 | 1003 |
| 539377 | TCTGCAGTCATGTACAC | Intron 2 | 87 | 156596 | 156612 | 1004 |
| 539378 | TGGTTTGTCAATCCTTT | Intron 2 | 95 | 156889 | 156905 | 1005 |
| 539379 | TTGGTTTGTCAATCCTT | Intron 2 | 97 | 156890 | 156906 | 1006 |
| 539380 | CTTGGTTTGTCAATCCT | Intron 2 | 97 | 156891 | 156907 | 1007 |
| 539381 | TACAATGCACAGGACAC | Intron 2 | 65 | 157201 | 157217 | 1008 |
| 539382 | CTACAATGCACAGGACA | Intron 2 | 85 | 157202 | 157218 | 1009 |
| 539383 | GCTACAATGCACAGGAC | Intron 2 | 96 | 157203 | 157219 | 1010 |
| 539384 | GATATTTATTGCTGTAC | Intron 2 | 43 | 158007 | 158023 | 1011 |
| 539385 | TGATATTTATTGCTGTA | Intron 2 | 35 | 158008 | 158024 | 1012 |
| 539386 | CTGATATTTATTGCTGT | Intron 2 | 38 | 158009 | 158025 | 1013 |
| 539387 | AGGGTCTTTACAAAGTT | Intron 2 | 61 | 162751 | 162767 | 1014 |
| 539388 | CAGGGTCTTTACAAAGT | Intron 2 | 65 | 162752 | 162768 | 1015 |
| 539389 | CCAGGGTCTTTACAAAG | Intron 2 | 88 | 162753 | 162769 | 1016 |
| 539390 | TTCTGCAGTATCCTAGC | Intron 2 | 72 | 166352 | 166368 | 1017 |
| 539391 | TTTCTGCAGTATCCTAG | Intron 2 | 53 | 166353 | 166369 | 1018 |
| 539392 | GTTTCTGCAGTATCCTA | Intron 2 | 84 | 166354 | 166370 | 1019 |
| 539393 | AGTTTCTGCAGTATCCT | Intron 2 | 78 | 166355 | 166371 | 1020 |
| 539394 | CAGTTTCTGCAGTATCC | Intron 2 | 77 | 166356 | 166372 | 1021 |
| 539395 | CAAATTCCAGTCCTAGG | Intron 2 | 60 | 172746 | 172762 | 1022 |

TABLE 136-continued

Inhibition of GHR mRNA by 3-10-4 MOE gapmers targeting introns 2 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 539396 | CCAAATTCCAGTCCTAG | Intron 2 | 75 | 172747 | 172763 | 1023 |
| 539397 | TCCAAATTCCAGTCCTA | Intron 2 | 62 | 172748 | 172764 | 1024 |
| 539398 | AACCCATTTCATCCATT | Intron 2 | 82 | 175372 | 175388 | 1025 |
| 539399 | GAACCCATTTCATCCAT | Intron 2 | 86 | 175373 | 175389 | 1026 |
| 539400 | GGAACCCATTTCATCCA | Intron 2 | 84 | 175374 | 175390 | 1027 |
| 539401 | GCTTCATGTCTTTCTAG | Intron 2 | 88 | 189119 | 189135 | 1028 |
| 539402 | TGCTTCATGTCTTTCTA | Intron 2 | 77 | 189120 | 189136 | 1029 |
| 539403 | GTGCTTCATGTCTTTCT | Intron 2 | 95 | 189121 | 189137 | 1030 |
| 539404 | TGAGCTTAGCAGTCACT | Intron 2 | 92 | 189484 | 189500 | 1031 |
| 539405 | CATGAGCTTAGCAGTCA | Intron 2 | 82 | 189486 | 189502 | 1032 |
| 539406 | TACAGACATAGCTCTAA | Intron 2 | 45 | 191142 | 191158 | 1033 |
| 539407 | ATACAGACATAGCTCTA | Intron 2 | 53 | 191143 | 191159 | 1034 |
| 539408 | GATACAGACATAGCTCT | Intron 2 | 67 | 191144 | 191160 | 1035 |
| 539409 | TGTGGCTTTAATTCACT | Intron 2 | 70 | 198148 | 198164 | 1036 |
| 539410 | ATGTGGCTTTAATTCAC | Intron 2 | 40 | 198149 | 198165 | 1037 |
| 539411 | TATGTGGCTTTAATTCA | Intron 2 | 35 | 198150 | 198166 | 1038 |
| 539412 | TGTTCAGTTGCATCACG | Intron 2 | 84 | 199816 | 199832 | 1039 |
| 539413 | GTGTTCAGTTGCATCAC | Intron 2 | 80 | 199817 | 199833 | 1040 |
| 539414 | TGTGTTCAGTTGCATCA | Intron 2 | 74 | 199818 | 199834 | 1041 |
| 539415 | CATCTGGATGTGAGGCT | Intron 3 | 82 | 210561 | 210577 | 1042 |
| 539416 | ACATCTGGATGTGAGGC | Intron 3 | 86 | 210562 | 210578 | 1043 |
| 539417 | CACATCTGGATGTGAGG | Intron 3 | 55 | 210563 | 210579 | 1044 |
| 539418 | TCAGGTAATTTCTGGAA | Intron 3 | 35 | 219019 | 219035 | 1045 |
| 539419 | CTCAGGTAATTTCTGGA | Intron 3 | 44 | 219020 | 219036 | 1046 |
| 539420 | TCTCAGGTAATTTCTGG | Intron 3 | 31 | 219021 | 219037 | 1047 |
| 539421 | TTGCTTATTTACCTGGG | Intron 3 | 0 | 225568 | 225584 | 1048 |
| 539422 | TTTGCTTATTTACCTGG | Intron 3 | 38 | 225569 | 225585 | 1049 |
| 539423 | TTTTGCTTATTTACCTG | Intron 3 | 33 | 225570 | 225586 | 1050 |
| 539424 | ATGATGTTACTACTACT | Intron 3 | 29 | 229618 | 229634 | 1051 |
| 539425 | AATGATGTTACTACTAC | Intron 3 | 10 | 229619 | 229635 | 1052 |
| 539426 | CAATGATGTTACTACTA | Intron 3 | 0 | 229620 | 229636 | 1053 |
| 539427 | CCCCTAGAGCAATGGTC | Intron 3 | 67 | 232826 | 232842 | 1054 |
| 539428 | CCCCCTAGAGCAATGGT | Intron 3 | 65 | 232827 | 232843 | 1055 |
| 539429 | TCCCCCTAGAGCAATGG | Intron 3 | 45 | 232828 | 232844 | 1056 |
| 539430 | TCAATTGCAGATGCTCT | Intron 3 | 78 | 237675 | 237691 | 1057 |
| 539431 | CTCAATTGCAGATGCTC | Intron 3 | 82 | 237676 | 237692 | 1058 |

TABLE 136-continued

Inhibition of GHR mRNA by 3-10-4 MOE gapmers targeting introns 2 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 539432 | GCTCAATTGCAGATGCT | Intron 3 | 92 | 237677 | 237693 | 1059 |
| 539433 | AGCTCAATTGCAGATGC | Intron 3 | 85 | 237678 | 237694 | 1060 |
| 539434 | GTATATTCAGTCCAAGG | Intron 3 | 73 | 248231 | 248247 | 1061 |
| 539435 | AGTATATTCAGTCCAAG | Intron 3 | 70 | 248232 | 248248 | 1062 |
| 539436 | CAGTATATTCAGTCCAA | Intron 3 | 40 | 248233 | 248249 | 1063 |

TABLE 137

Inhibition of GHR mRNA by 5-10-5 MOE gapmers targeting introns 1 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 532502 | GAGTATTTCAGGCTGGAAAA | Intron 3 | 43 | 214623 | 214642 | 1064 |
| 533404 | GTAACTCAGGAATGGAAAAC | Intron 1 | 56 | 26501<br>113035<br>121992 | 26520<br>113054<br>122011 | 1065 |
| 533405 | AGTAACTCAGGAATGGAAAA | Intron 1 | 41 | 26502<br>113036<br>121993 | 26521<br>113055<br>122012 | 1066 |
| 533406 | AAGTAACTCAGGAATGGAAA | Intron 1 | 43 | 26503<br>113037<br>121994 | 26522<br>113056<br>122013 | 1067 |
| 533407 | GAGATTTCAAATAAATCTCA | Intron 1 | 0 | 143207<br>143235<br>143263<br>143291<br>143319<br>143347<br>143375<br>143403<br>143431<br>143459 | 143226<br>143254<br>143282<br>143310<br>143338<br>143366<br>143394<br>143422<br>143450<br>143478 | 1068 |
| 533408 | TGAGATTTCAAATAAATCTC | Intron 1 | 11 | 143208<br>143236<br>143264<br>143292<br>143320<br>143348<br>143376<br>143404<br>143432<br>143460 | 143227<br>143255<br>143283<br>143311<br>143339<br>143367<br>143395<br>143423<br>143451<br>143479 | 1069 |
| 533409 | GTGAGATTTCAAATAAATCT | Intron 1 | 0 | 143209<br>143237<br>143265<br>143293<br>143321<br>143349<br>143377<br>143405<br>143433<br>143461 | 143228<br>143256<br>143284<br>143312<br>143340<br>143368<br>143396<br>143424<br>143452<br>143480 | 1070 |

TABLE 137-continued

Inhibition of GHR mRNA by 5-10-5 MOE gapmers targeting
introns 1 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 533410 | TGTGAGATTTCAAATAAATC | Intron 1 | 0 | 143210 143238 143266 143294 143322 143350 143378 143406 143434 143462 | 143229 143257 143285 143313 143341 143369 143397 143425 143453 143481 | 1071 |
| 533411 | TTGTGAGATTTCAAATAAAT | Intron 1 | 10 | 143183 143211 143239 143267 143295 143323 143351 143379 143407 143435 143463 | 143202 143230 143258 143286 143314 143342 143370 143398 143426 143454 143482 | 1072 |
| 533412 | TTTGTGAGATTTCAAATAAA | Intron 1 | 0 | 143184 143212 143240 143296 143324 143352 143380 143464 | 143203 143231 143259 143315 143343 143371 143399 143483 | 1073 |
| 533413 | CTTTGTGAGATTTCAAATAA | Intron 1 | 20 | 143185 143213 143241 143297 143325 143353 143381 143465 | 143204 143232 143260 143316 143344 143372 143400 143484 | 1074 |
| 533414 | ACTTTGTGAGATTTCAAATA | Intron 1 | 57 | 143186 143214 143242 143298 143326 143354 143382 143466 | 143205 143233 143261 143317 143345 143373 143401 143485 | 1075 |
| 533415 | CACTTTGTGAGATTTCAAAT | Intron 1 | 69 | 143187 143215 143243 143299 143327 143355 143383 143467 | 143206 143234 143262 143318 143346 143374 143402 143486 | 1076 |
| 533895 | AGTATTTCAGGCTGGAAAAA | Intron 3 | 35 | 214622 | 214641 | 1077 |
| 533896 | TGAGTATTTCAGGCTGGAAA | Intron 3 | 55 | 214624 | 214643 | 1078 |
| 533897 | TCTGAGTATTTCAGGCTGGA | Intron 3 | 71 | 214626 | 214645 | 1079 |
| 533898 | ATCTGAGTATTTCAGGCTGG | Intron 3 | 77 | 214627 | 214646 | 1080 |
| 533899 | TATCTGAGTATTTCAGGCTG | Intron 3 | 58 | 214628 | 214647 | 1081 |
| 533900 | TTTTGTGTTATGCCTTGAGG | Intron 3 | 51 | 221483 | 221502 | 1082 |

TABLE 137-continued

Inhibition of GHR mRNA by 5-10-5 MOE gapmers targeting introns 1 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 533901 | TTTTTGTGTTATGCCTTGAG | Intron 3 | 55 | 221484 | 221503 | 1083 |
| 533902 | ATTTTTGTGTTATGCCTTGA | Intron 3 | 57 | 221485 | 221504 | 1084 |
| 533903 | ATATTTTTGTGTTATGCCTT | Intron 3 | 56 | 221487 | 221506 | 1085 |
| 533904 | AATATTTTTGTGTTATGCCT | Intron 3 | 61 | 221488 | 221507 | 1086 |
| 533905 | AAATATTTTTGTGTTATGCC | Intron 3 | 18 | 221489 | 221508 | 1087 |
| 533906 | TTGCTTATTTACCTGGGTAA | Intron 3 | 58 | 225565 | 225584 | 1088 |
| 533907 | TTTGCTTATTTACCTGGGTA | Intron 3 | 64 | 225566 | 225585 | 1089 |
| 533908 | TTTTGCTTATTTACCTGGGT | Intron 3 | 77 | 225567 | 225586 | 1090 |
| 533909 | CCTTTTGCTTATTTACCTGG | Intron 3 | 69 | 225569 | 225588 | 1091 |
| 533910 | GCCTTTTGCTTATTTACCTG | Intron 3 | 69 | 225570 | 225589 | 1092 |
| 533911 | TGCCTTTTGCTTATTTACCT | Intron 3 | 55 | 225571 | 225590 | 1093 |
| 533912 | ATGATGTTACTACTACTCAA | Intron 3 | 60 | 229615 | 229634 | 1094 |
| 533913 | AATGATGTTACTACTACTCA | Intron 3 | 48 | 229616 | 229635 | 1095 |
| 533914 | CAATGATGTTACTACTACTC | Intron 3 | 57 | 229617 | 229636 | 1096 |
| 533915 | TCCAATGATGTTACTACTAC | Intron 3 | 69 | 229619 | 229638 | 1097 |
| 533916 | TTCCAATGATGTTACTACTA | Intron 3 | 74 | 229620 | 229639 | 1098 |
| 533917 | ATTCCAATGATGTTACTACT | Intron 3 | 74 | 229621 | 229640 | 1099 |
| 533918 | CCCCTAGAGCAATGGTCTAG | Intron 3 | 71 | 232823 | 232842 | 1100 |
| 533919 | CCCCCTAGAGCAATGGTCTA | Intron 3 | 44 | 232824 | 232843 | 1101 |
| 533920 | TCCCCCTAGAGCAATGGTCT | Intron 3 | 54 | 232825 | 232844 | 1102 |
| 533921 | TATCCCCCTAGAGCAATGGT | Intron 3 | 62 | 232827 | 232846 | 1103 |
| 533922 | ATATCCCCCTAGAGCAATGG | Intron 3 | 50 | 232828 | 232847 | 1104 |
| 533923 | AATATCCCCCTAGAGCAATG | Intron 3 | 61 | 232829 | 232848 | 1105 |
| 533924 | GCTCACATTTGGAAGACAGT | Intron 3 | 68 | 233623 | 233642 | 1106 |
| 533925 | GGCTCACATTTGGAAGACAG | Intron 3 | 74 | 233624 | 233643 | 1107 |
| 533926 | AGGCTCACATTTGGAAGACA | Intron 3 | 56 | 233625 | 233644 | 1108 |
| 533927 | AGAGGCTCACATTTGGAAGA | Intron 3 | 34 | 233627 | 233646 | 1109 |
| 533928 | TAGAGGCTCACATTTGGAAG | Intron 3 | 18 | 233628 | 233647 | 1110 |
| 533929 | TTAGAGGCTCACATTTGGAA | Intron 3 | 19 | 233629 | 233648 | 1111 |
| 533930 | CTCAATTGCAGATGCTCTGA | Intron 3 | 66 | 237673 | 237692 | 1112 |
| 533931 | GCTCAATTGCAGATGCTCTG | Intron 3 | 72 | 237674 | 237693 | 1113 |
| 533932 | AGCTCAATTGCAGATGCTCT | Intron 3 | 74 | 237675 | 237694 | 1114 |
| 533933 | AAAGCTCAATTGCAGATGCT | Intron 3 | 66 | 237677 | 237696 | 1115 |
| 533934 | TAAAGCTCAATTGCAGATGC | Intron 3 | 59 | 237678 | 237697 | 1116 |
| 533935 | ATAAAGCTCAATTGCAGATG | Intron 3 | 23 | 237679 | 237698 | 1117 |
| 533936 | GTGAGTCCATTAAACCTCTT | Intron 3 | 73 | 244873 | 244892 | 1118 |

TABLE 137-continued

Inhibition of GHR mRNA by 5-10-5 MOE gapmers targeting introns 1 and 3 of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 533937 | TGTGAGTCCATTAAACCTCT | Intron 3 | 73 | 244874 | 244893 | 1119 |
| 533938 | ACTGTGAGTCCATTAAACCT | Intron 3 | 17 | 244876 | 244895 | 1120 |
| 533939 | AACTGTGAGTCCATTAAACC | Intron 3 | 19 | 244877 | 244896 | 1121 |
| 533940 | GAACTGTGAGTCCATTAAAC | Intron 3 | 28 | 244878 | 244897 | 1122 |
| 533941 | ATATTGAAAGGCCCATCAAA | Intron 3 | 13 | 246498 | 246517 | 1123 |
| 533942 | AATATTGAAAGGCCCATCAA | Intron 3 | 31 | 246499 | 246518 | 1124 |
| 533943 | AAATATTGAAAGGCCCATCA | Intron 3 | 51 | 246500 | 246519 | 1125 |
| 533944 | GAAAATATTGAAAGGCCCAT | Intron 3 | 22 | 246502 | 246521 | 1126 |
| 533945 | GGAAAATATTGAAAGGCCCA | Intron 3 | 42 | 246503 | 246522 | 1127 |
| 533946 | AGGAAAATATTGAAAGGCCC | Intron 3 | 28 | 246504 | 246523 | 1128 |
| 533947 | GTATATTCAGTCCAAGGATC | Intron 3 | 65 | 248228 | 248247 | 1129 |
| 533948 | AGTATATTCAGTCCAAGGAT | Intron 3 | 63 | 248229 | 248248 | 1130 |
| 533949 | CAGTATATTCAGTCCAAGGA | Intron 3 | 67 | 248230 | 248249 | 1131 |
| 533950 | AACAGTATATTCAGTCCAAG | Intron 3 | 56 | 248232 | 248251 | 1132 |
| 533951 | AAACAGTATATTCAGTCCAA | Intron 3 | 60 | 248233 | 248252 | 1133 |
| 533952 | AAAACAGTATATTCAGTCCA | Intron 3 | 59 | 248234 | 248253 | 1134 |
| 533953 | TCTATTGTTGCCACCTTTAT | Intron 3 | 45 | 252838 | 252857 | 1135 |
| 533954 | TTCTATTGTTGCCACCTTTA | Intron 3 | 52 | 252839 | 252858 | 1136 |
| 533955 | TTTCTATTGTTGCCACCTTT | Intron 3 | 46 | 252840 | 252859 | 1137 |
| 533956 | AGTTTCTATTGTTGCCACCT | Intron 3 | 59 | 252842 | 252861 | 1138 |
| 533957 | CAGTTTCTATTGTTGCCACC | Intron 3 | 41 | 252843 | 252862 | 1139 |
| 533958 | CCAGTTTCTATTGTTGCCAC | Intron 3 | 48 | 252844 | 252863 | 1140 |

TABLE 138

Inhibition of GHR mRNA by 5-10-5 MOE gapmers targeting intron 3 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532454 | GCAGAACTGATTGCTTACTT | 78 | 182862 | 182881 | 1141 |
| 532455 | AGGTCATAAGATTTTCATTT | 48 | 183533 | 183552 | 1142 |
| 532456 | GCCTCTGGCCATAAAGAAAT | 54 | 183578 | 183597 | 1143 |
| 532457 | AAAGTTTAAGAGGCACCCCA | 31 | 184508 | 184527 | 1144 |
| 532458 | GAATAAGCACAAAAGTTTAA | 28 | 184519 | 184538 | 1145 |
| 532459 | GAACCAAATAAACCTCTCTT | 52 | 185452 | 185471 | 1146 |

TABLE 138-continued

Inhibition of GHR mRNA by 5-10-5 MOE gapmers targeting intron 3 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532460 | ATGTTGAAATTTGATCCCCA | 79 | 185763 | 185782 | 1147 |
| 532461 | TGTGAGAGCTCACTCACTAT | 42 | 186134 | 186153 | 1148 |
| 532462 | CTTGTGAGAGCTCACTCACT | 72 | 186136 | 186155 | 1149 |
| 532463 | ACATGGTGGCAGGAGAGAGG | 42 | 186206 | 186225 | 1150 |
| 532464 | CTAGAAAGAAACTACCTGAG | 12 | 186341 | 186360 | 1151 |
| 532465 | AACTTCAGTTGTAAAATAAT | 27 | 187044 | 187063 | 1152 |
| 532466 | GAAAGGATTTTGAGATTTC | 43 | 188897 | 188916 | 1153 |
| 532467 | CTTAGCTGTCAAGGCCCTTT | 80 | 189084 | 189103 | 1154 |
| 532468 | TGTGCTTCATGTCTTTCTAG | 88 | 189119 | 189138 | 1155 |
| 532469 | CCCTTGAACATGCTATCCTT | 85 | 189256 | 189275 | 1156 |
| 532470 | CTTGCAGGGATGCATCTCAG | 87 | 189625 | 189644 | 1157 |
| 532471 | TCTCTTGCACATCTAATTTC | 82 | 189656 | 189675 | 1158 |
| 532472 | CTTCCAGCACAACCCATCAC | 77 | 190109 | 190128 | 1159 |
| 532473 | GTAACTACATTCCCTTTATC | 52 | 190860 | 190879 | 1160 |
| 532474 | AGTAACTACATTCCCTTTAT | 58 | 190861 | 190880 | 1161 |
| 532475 | CAGATAGCACAGGGCTAAAA | 84 | 190979 | 190998 | 1162 |
| 532476 | AGAATCAGGAATGTTTGCCT | 86 | 192904 | 192923 | 1163 |
| 532477 | TGACTCAATCATTTAGACTT | 45 | 192990 | 193009 | 1164 |
| 532478 | TCAACAGTCAATGGACTTGT | 71 | 193042 | 193061 | 1165 |
| 532479 | AATTTCTACTGCTATGATGC | 75 | 194806 | 194825 | 1166 |
| 532480 | ATGGTTCCAAATTTCTATCT | 86 | 195704 | 195723 | 1167 |
| 532481 | CTGTATGGCTTTAAGTATTC | 63 | 196756 | 196775 | 1168 |
| 532482 | AACTTATGAACTGTTCACCA | 86 | 198307 | 198326 | 1169 |
| 532483 | AATAAGCTTGAAGTCTGAAG | 63 | 199520 | 199539 | 1170 |
| 532484 | TAGTTATCTAACTGCCCAAT | 77 | 199544 | 199563 | 1171 |
| 532485 | TTCTGCAAAGCTTCCCAGTA | 72 | 200314 | 200333 | 1172 |
| 532486 | ACAACTTCAAGCTTCACATA | 65 | 200599 | 200618 | 1173 |
| 532487 | GAATCAATGTTCTGGCAAGA | 52 | 201842 | 201861 | 1174 |
| 532488 | CAGCCTTTCAGCTGTGAAAG | 52 | 204181 | 204200 | 1175 |
| 532489 | AACAATGCCAAGAAATCTAT | 74 | 204369 | 204388 | 1176 |
| 532490 | CCCACAGTAACAATGCCAAG | 90 | 204377 | 204396 | 1177 |
| 532491 | TTTTACCTCCCAGTGAAACT | 34 | 205896 | 205915 | 1178 |
| 532492 | TAATTGTTGATCCATGATGT | 5 | 208856 | 208875 | 1179 |
| 532493 | GTTGGAGAGACAAGTTTAAC | 29 | 208975 | 208994 | 1180 |
| 532494 | AGTCATAAAATTCAAATTAT | 39 | 209537 | 209556 | 1181 |
| 532495 | GGCCTTGGGCACACTTTCTC | 82 | 207510 | 207529 | 1182 |

TABLE 138-continued

Inhibition of GHR mRNA by 5-10-5 MOE gapmers targeting intron 3 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| | | | 210189 | 210208 | |
| 532496 | AAGTTTTTATTGAAGTTAAT | 0 | 212551 | 212570 | 1183 |
| 532497 | AAGAAAAATTAGGAAGCTAG | 31 | 212649 | 212668 | 1184 |
| 532498 | CAGGGAGATAAGTTTATTCA | 61 | 212797 | 212816 | 1185 |
| 532499 | ATTTAATACACATTGGAATA | 15 | 213390 | 213409 | 1186 |
| 532500 | GTAGGACTATTTATGATTCC | 86 | 213914 | 213933 | 1187 |
| 532501 | CACTCTCTTGGGCTGTTAAG | 82 | 214479 | 214498 | 1188 |
| 532502 | GAGTATTTCAGGCTGGAAAA | 66 | 214623 | 214642 | 1064 |
| 532503 | TTGTTTGAGTTCCAAAAGAA | 39 | 214932 | 214951 | 1189 |
| 532504 | TTTGCCATGAGACACACAAT | 77 | 215932 | 215951 | 1190 |
| 532505 | CACCAAACCTCAGAGACATG | 80 | 216468 | 216487 | 1191 |
| 532506 | CCACTGTTAAGTGATGCATG | 83 | 217480 | 217499 | 1192 |
| 532507 | CTCTCAGGTAATTTCTGGAA | 86 | 219019 | 219038 | 1193 |
| 532508 | GCTCCTCACAATGACCCTTT | 84 | 219452 | 219471 | 1194 |
| 532509 | GGGACTGGCACTGGTAATTT | 56 | 220062 | 220081 | 1195 |
| 532510 | CTAACCATTAGTTACTGTAT | 69 | 220558 | 220577 | 1196 |
| 532511 | GGATTTTAGGTTCTTGCTGT | 51 | 221588 | 221607 | 1197 |
| 532512 | TGAATCATATACTGATATCA | 63 | 222914 | 222933 | 1198 |
| 532513 | TTGAGGTATTAAATTTTAAA | 0 | 223001 | 223020 | 1199 |
| 532514 | AGTTTGTAATGTAGTGATTT | 19 | 223156 | 223175 | 1200 |
| 532515 | AAATATTTGATAGCTCACAT | 18 | 224409 | 224428 | 1201 |
| 532516 | AGAAATATTTGATAGCTCAC | 57 | 224411 | 224430 | 1202 |
| 532517 | CCACATTTCAAATGTTCTCT | 80 | 224717 | 224736 | 1203 |
| 532518 | GCAGGAAGAGTGGCATGGAC | 59 | 224750 | 224769 | 1204 |
| 532519 | CACTTATCCAAATGCAGAGA | 82 | 225742 | 225761 | 1205 |
| 532520 | CAAGGTAATGGGAGGCTAGC | 47 | 225903 | 225922 | 1206 |
| 532521 | ATAGTCAAAGCTAAGGATAT | 4 | 226177 | 226196 | 1207 |
| 532522 | GTAATTTCATTCATGCTTCC | 67 | 226804 | 226823 | 1208 |
| 532523 | GTCCACATTCAGCTGTGTGT | 72 | 231912 | 231931 | 1209 |
| 532524 | TCATTCAGGAAATTCTGCTA | 62 | 232286 | 232305 | 1210 |
| 532525 | AACATGTCTCATTCAGGAAA | 71 | 232294 | 232313 | 1211 |
| 532526 | TAACATGTCTCATTCAGGAA | 85 | 232295 | 232314 | 1212 |
| 532527 | AGATTCCTCAAATTCAGTGA | 66 | 232389 | 232408 | 1213 |
| 532528 | TAAGCGGAAAAGGAGAAAAG | 0 | 233684 | 233703 | 1214 |

TABLE 138-continued

Inhibition of GHR mRNA by 5-10-5 MOE gapmers
targeting intron 3 of SEQ ID NO: 2

| ISIS NO | Sequence | % inhibition | SEQ ID NO: 2 Start Site | SEQ ID NO: 2 Stop Site | SEQ ID NO |
|---|---|---|---|---|---|
| 532529 | AAAGCAAGAGAATTCCTAAA | 32 | 234203 | 234222 | 1215 |
| 532530 | AATGAACCTTTAACTTAGTA | 40 | 234876 | 234895 | 1216 |

TABLE 139

Inhibition of GHR mRNA by 5-10-5 MOE gapmers targeting introns 3-8 and
intron-exonic regions of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 523792 | AAAGCTTTGTGGATAAAGTT | Intron 3 | 44 | 213025 | 213044 | 1217 |
| 523793 | GAAGGAAAGGTTCTGTGGAA | Intron 3 | 38 | 213825 | 213844 | 1218 |
| 523794 | CTGAGTATTTCAGGCTGGAA | Intron 3 | 84 | 214625 | 214644 | 1219 |
| 523795 | TTGAATTATCCCTTTAAAAA | Intron 3 | 38 | 215446 | 215465 | 1220 |
| 523796 | TTTAGAATGGTTTGGCATAC | Intron 3 | 66 | 216365 | 216384 | 1221 |
| 523797 | GATATGTCCACATTGATTAG | Intron 3 | 65 | 218132 | 218151 | 1222 |
| 523798 | ATTATTTAAGCTTCTACTTT | Intron 3 | 44 | 218973 | 218992 | 1223 |
| 523799 | ATACATGGCAATTAAAAGAT | Intron 3 | 26 | 219886 | 219905 | 1224 |
| 523800 | TGAGATAGTGTGGGAAATAT | Intron 3 | 18 | 220686 | 220705 | 1225 |
| 523801 | TATTTTTGTGTTATGCCTTG | Intron 3 | 73 | 221486 | 221505 | 1226 |
| 523802 | TTATTAACTAGAATATGCCT | Intron 3 | 16 | 223110 | 223129 | 1227 |
| 523803 | GATTATTCTATTTTTATTTT | Intron 3 | 33 | 223948 | 223967 | 1228 |
| 523804 | AGGAAGAGTGGCATGGACAT | Intron 3 | 43 | 224748 | 224767 | 1229 |
| 523805 | CTTTTGCTTATTTACCTGGG | Intron 3 | 84 | 225568 | 225587 | 1230 |
| 523806 | TTTATATTATTAATATCATT | Intron 3 | 31 | 226371 | 226390 | 1231 |
| 523807 | GGTACATGGCTTTTAAGTGG | Intron 3 | 53 | 227218 | 227237 | 1232 |
| 523808 | AATATTGGTCAGGTTTAAGA | Intron 3 | 28 | 228018 | 228037 | 1233 |
| 523809 | ATTTCATCTCTTTCTTAGTT | Intron 3 | 45 | 228818 | 228837 | 1234 |
| 523810 | CCAATGATGTTACTACTACT | Intron 3 | 89 | 229618 | 229637 | 1235 |
| 523811 | GTTCCCCAACCCCTTGGAA | Intron 3 | 28 | 230418 | 230437 | 1236 |
| 523812 | TATAGGAAGTGAGATGTATG | Intron 3 | 46 | 231218 | 231237 | 1237 |
| 523813 | ATTATTCTAGAAGAAGATTT | Intron 3 | 12 | 232018 | 232037 | 1238 |
| 523814 | ATCCCCCTAGAGCAATGGTC | Intron 3 | 79 | 232826 | 232845 | 1239 |
| 523815 | GAGGCTCACATTTGGAAGAC | Intron 3 | 69 | 233626 | 233645 | 1240 |
| 523816 | TACACAAATCCAAGGCAGAG | Intron 3 | 57 | 234447 | 234466 | 1241 |
| 523817 | AGGAAGAGTGGGAGTGTTAC | Intron 3 | 35 | 235258 | 235277 | 1242 |
| 523818 | GTCCCTGACTAGGCATTTTG | Intron 3 | 43 | 236071 | 236090 | 1243 |

TABLE 139-continued

Inhibition of GHR mRNA by 5-10-5 MOE gapmers targeting introns 3-8 and intron-exonic regions of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 523819 | AAGCTCAATTGCAGATGCTC | Intron 3 | 80 | 237676 | 237695 | 1244 |
| 523820 | CTGTGAGTCCATTAAACCTC | Intron 3 | 81 | 244875 | 244894 | 1245 |
| 523821 | TGAAATGTGGCTAGTGTGAC | Intron 3 | 51 | 245701 | 245720 | 1246 |
| 523822 | AAAATATTGAAAGGCCCATC | Intron 3 | 68 | 246501 | 246520 | 1247 |
| 523823 | AATGTCAATAGTGCCCTATT | Intron 3 | 48 | 247431 | 247450 | 1248 |
| 523824 | ACAGTATATTCAGTCCAAGG | Intron 3 | 82 | 248231 | 248250 | 1249 |
| 523825 | TGTCTATTTAAGTTTGTTGC | Intron 3 | 45 | 250001 | 250020 | 1250 |
| 523826 | TTCAAGTACTGTCATGAATA | Intron 3 | 47 | 251214 | 251233 | 1251 |
| 523827 | TTTCTTTTTCTTAAACTAAG | Intron 3 | 11 | 252041 | 252060 | 1252 |
| 523828 | GTTTCTATTGTTGCCACCTT | Intron 3 | 70 | 252841 | 252860 | 1253 |
| 523829 | AAGGCCACATATTATAGTAT | Intron 3 | 29 | 253698 | 253717 | 1254 |
| 523830 | ACCTGAACTATTAATTTCTT | Intron 3 | 19 | 255397 | 255416 | 1255 |
| 523831 | GAATGGGCTGAGTAGTTGAA | Intron 3 | 47 | 256197 | 256216 | 1256 |
| 523832 | TGATGAACATTGCTAATTTG | Intron 3 | 26 | 257018 | 257037 | 1257 |
| 523833 | ATCTTGCCTCGATGAAAGTT | Intron 3 | 17 | 257818 | 257837 | 1258 |
| 523834 | TTAAGTGGCACAGCCATGAT | Intron 3 | 9 | 258774 | 258793 | 1259 |
| 523835 | AATGAGTTAAGTTGGAACAC | Intron 3 | 25 | 261294 | 261313 | 1260 |
| 523836 | TCCTTAGTAGAATGCCTGGA | Intron 3 | 57 | 263338 | 263357 | 1261 |
| 523837 | TATGTAGAAAAATAAGCTGG | Intron 3 | 0 | 266514 | 266533 | 1262 |
| 523838 | GCCGAGGCAGGCACCTGAGT | Intron 3 | 43 | 267375 | 267394 | 1263 |
| 523839 | TGGTACCTATATTGAGAGGT | Intron 4 | 46 | 269052 | 269071 | 1264 |
| 523840 | TTAAGGAAAAATATAGTATA | Intron 4 | 7 | 269854 | 269873 | 1265 |
| 523841 | TTATTTATGTGTCAGGGATG | Intron 4 | 28 | 270668 | 270687 | 1266 |
| 523842 | CAAAAGTTAAGTGCTTTAGG | Intron 4 | 10 | 271468 | 271487 | 1267 |
| 523843 | TTCATAGATGTCTAAGGAAT | Intron 4 | 32 | 273341 | 273360 | 1268 |
| 523844 | ACCTGTGATTTACCTATTTC | Exon 5-intron 5 junction | 18 | 274185 | 274204 | 1269 |
| 523845 | TGCCTAGAAAACCACATAAA | Intron 5 | 38 | 274985 | 275004 | 1270 |
| 523846 | AAACATCCTCAAAGGTACCT | Intron 5 | 64 | 275808 | 275827 | 1271 |
| 523847 | CTTCCCTGAGACACACACAT | Intron 5 | 35 | 276617 | 276636 | 1272 |
| 523848 | CTTCTTCAATCTTCTCATAC | Intron 5 | 33 | 278288 | 278307 | 1273 |
| 523849 | TACCATTTTCCATTTAGTTT | Exon 6-intron 6 junction | 7 | 279088 | 279107 | 1274 |
| 523850 | ATTGGCATCTTTTTCAGTGG | Intron 6 | 34 | 279902 | 279921 | 1275 |
| 523851 | TCAAGCTCACGGTTGGAGAC | Intron 6 | 36 | 280799 | 280818 | 1276 |
| 523852 | AAATGAAATCAGTATGTTGA | Intron 6 | 0 | 281622 | 281641 | 1277 |
| 523853 | TGATTTATCACAAAGGTGCT | Intron 6 | 29 | 282437 | 282456 | 1278 |

TABLE 139-continued

Inhibition of GHR mRNA by 5-10-5 MOE gapmers targeting introns 3-8 and intron-exonic regions of SEQ ID NO: 2

| ISIS NO | Sequence | Target region | % inhibition | SEQ ID NO: 2 Start Site | SEQ ID NO: 2 Stop Site | SEQ ID NO |
|---|---|---|---|---|---|---|
| 523854 | AAAACAGTAGAAAAGATTAA | Intron 6 | 14 | 284073 | 284092 | 1279 |
| 523855 | CTACATCACAGCAGTCAGAA | Intron 6 | 23 | 285187 | 285206 | 1280 |
| 523856 | AAAAGATGTAAGTGTGACAT | Intron 6 | 28 | 286349 286919 | 286368 286938 | 1281 |
| 523857 | TTACAAGAACTGCTAAAGGG | Intron 6 | 15 | 287151 | 287170 | 1282 |
| 523858 | ATAAAGAAAAAGTTAACTGA | Intron 6 | 9 | 287982 | 288001 | 1283 |
| 523859 | AGATAATATACTTCTTCTAT | Intron 6 | 4 | 288809 | 288828 | 1284 |
| 523860 | CCTTCTTCACATGTAAATTG | Exon 7-intron 7 junction | 19 | 290456 | 290475 | 1285 |
| 523861 | TTTCTATGTAGCTTGTGGTT | Intron 7 | 30 | 291258 | 291277 | 1286 |
| 523862 | AGGCAGAGTTTTTATTGATA | Intron 7 | 19 | 292058 | 292077 | 1287 |
| 523863 | ATAGTCACCAGCCTAAGCCT | Intron 8 | 28 | 292858 | 292877 | 1288 |
| 523864 | AGACTTTTAGCATGCTTGAC | Intron 8 | 56 | 293658 | 293677 | 1289 |
| 523865 | TTTACAGCCCTACAGTTCTA | Intron 8 | 7 | 294464 | 294483 | 1290 |
| 523866 | CCAGAGAACCTGACTCCAAA | Intron 8 | 6 | 295330 | 295349 | 1291 |
| 523867 | CAGAAGAAAATATTAGACAG | Intron 8 | 10 | 296993 | 297012 | 1292 |

TABLE 140

Inhibition of GHR mRNA by 5-10-5 MOE gapmers targeting introns 3-8 of SEQ ID NO: 2

| ISIS NO | Sequence | Target Region | % inhibition | SEQ ID NO: 2 Start Site | SEQ ID NO: 2 Stop Site | SEQ ID NO |
|---|---|---|---|---|---|---|
| 532531 | TATTATACTTCTAAATTCCC | Intron 3 | 70 | 236716 | 236735 | 1293 |
| 532532 | TAAAAGCAAGAAAAAGGAAC | Intron 3 | 52 | 236889 | 236908 | 1294 |
| 532533 | CCTAATTTATATGAACAAAC | Intron 3 | 56 | 237177 | 237196 | 1295 |
| 532534 | TGCAATGCCTTAGCCTAAAA | Intron 3 | 86 | 238087 | 238106 | 1296 |
| 532535 | CACCACCATTATTACACTAC | Intron 3 | 75 | 238186 | 238205 | 1297 |
| 532536 | AAATAAATCAGATTATTATA | Intron 3 | 52 | 238242 | 238261 | 1298 |
| 532537 | CTTAGATCTGTGCTGTCCAA | Intron 3 | 81 | 245758 | 245777 | 1299 |
| 532538 | GTTAGTGTTAGATTCTTTGA | Intron 3 | 67 | 246152 | 246171 | 1300 |
| 532539 | CATGCTCACGGCTGTGTTAC | Intron 3 | 66 | 246248 | 246267 | 1301 |
| 532540 | CCCATCAAATACTGAGTTCT | Intron 3 | 86 | 246487 | 246506 | 1302 |
| 532541 | GAAAGTAGTGATTAATGAGA | Intron 3 | 38 | 247012 | 247031 | 1303 |
| 532542 | ATTAATCAACAAGTGGCATT | Intron 3 | 72 | 247203 | 247222 | 1304 |
| 532543 | TTTAATTTTAGGGTTTAGAG | Intron 3 | 48 | 248344 | 248363 | 1305 |
| 532544 | CTTGCTACCACTAGAGCCTT | Intron 3 | 69 | 248694 | 248713 | 1306 |

TABLE 140-continued

Inhibition of GHR mRNA by 5-10-5 MOE gapmers targeting
introns 3-8 of SEQ ID NO: 2

| ISIS NO | Sequence | Target Region | % inhibition | SEQ ID NO: 2 Start Site | SEQ ID NO: 2 Stop Site | SEQ ID NO |
|---|---|---|---|---|---|---|
| 532545 | ACCACTGACTTATATCATTT | Intron 3 | 58 | 248743 | 248762 | 1307 |
| 532546 | TTCCCCATTGCTAATTTTGT | Intron 3 | 48 | 251601 | 251620 | 1308 |
| 532547 | TCCTGAAACTTAGTAGCTGG | Intron 3 | 83 | 253147 | 253166 | 1309 |
| 532548 | TGTCTTAAAAAGGAATAAAA | Intron 3 | 52 | 253785 | 253804 | 1310 |
| 532549 | CCTATAATAAAGTATTGTCT | Intron 3 | 70 | 253800 | 253819 | 1311 |
| 532550 | ATGTAAAATGGTATAGCTAC | Intron 3 | 50 | 254040 | 254059 | 1312 |
| 532551 | AACCCTCACACACTTCTGTT | Intron 3 | 71 | 254064 | 254083 | 1313 |
| 532552 | ATTCTGCATAAGCAGTGTTT | Intron 3 | 53 | 254246 | 254265 | 1314 |
| 532553 | TTACTACCCTGAAGAAGAAC | Intron 3 | 35 | 254314 | 254333 | 1315 |
| 532554 | AAGACCTATAACTTACTACC | Intron 3 | 49 | 254326 | 254345 | 1316 |
| 532555 | TTTCACAAGATTTACTTGGT | Intron 3 | 77 | 254641 | 254660 | 1317 |
| 532556 | CAGTTGTGATTGTCAACCTA | Intron 3 | 77 | 257073 | 257092 | 1318 |
| 532557 | AATCTTGCCTCGATGAAAGT | Intron 3 | 57 | 257819 | 257838 | 1319 |
| 532558 | TGGCCTAAATGTATCAGTTA | Intron 3 | 66 | 259157 | 259176 | 1320 |
| 532559 | AGGCTTTGGGTAAAATCTTT | Intron 3 | 67 | 259184 | 259203 | 1321 |
| 532560 | TATGATTTTAAAGATTAAA | Intron 3 | 20 | 261419 | 261438 | 1322 |
| 532561 | GTACAGTGAAAAGATGTGT | Intron 3 | 56 | 263666 | 263685 | 1323 |
| 532562 | GACAGGTATGAAGCAAACA | Intron 3 | 64 | 267033 | 267052 | 1324 |
| 532563 | TGAGCTGAGGGTCTTTGCCG | Intron 3 | 61 | 267391 | 267410 | 1325 |
| 532564 | AGGCTGAGTTGTACACAAAC | Intron 4 | 52 | 269422 | 269441 | 1326 |
| 532565 | ATGAGGAGGCTGAGTTGTAC | Intron 4 | 43 | 269428 | 269447 | 1327 |
| 532566 | TCATAAAGTGGGCCCAGCTT | Intron 4 | 70 | 270044 | 270063 | 1328 |
| 532567 | ACTCCTAATCCCTCAGTTTT | Intron 4 | 62 | 270492 | 270511 | 1329 |
| 532568 | TTTACATGCAAGGAGCTGAG | Intron 4 | 61 | 271047 | 271066 | 1330 |
| 532569 | TAATGCCCTTTCTCCCTACT | Intron 4 | 60 | 271215 | 271234 | 1331 |
| 532570 | CCTGTTTAGATTATCCCAAA | Intron 4 | 62 | 271763 | 271782 | 1332 |
| 532571 | CATGATTCACAGAATTTCTC | Intron 4 | 56 | 271831 | 271850 | 1333 |
| 532572 | AGTTAGAAAACTCAAAGTAT | Intron 4 | 2 | 271915 | 271934 | 1334 |
| 532573 | TCAAATGTACTTAGCATAAG | Intron 4 | 9 | 271947 | 271966 | 1335 |
| 532574 | ATATCAAATGTACTTAGCAT | Intron 4 | 59 | 271950 | 271969 | 1336 |
| 532575 | AAAGTTCAGAAGAGGGAATG | Intron 4 | 51 | 273233 | 273252 | 1337 |
| 532576 | AATTCCCATCTGAGTAGTTT | Intron 4 | 56 | 273440 | 273459 | 1338 |
| 532577 | GTCCCCTAATTTCAGGCTAA | Intron 4 | 31 | 273471 | 273490 | 1339 |
| 532578 | CTATGTCAAATGAAACAAAA | Intron 5 | 38 | 274205 | 274224 | 1340 |
| 532579 | TGATTATGCTTTGTGATAAA | Intron 5 | 42 | 274624 | 274643 | 1341 |
| 532580 | TCCAGCTGACTAGGAGGGCT | Intron 5 | 7 | 275732 | 275751 | 1342 |

TABLE 140-continued

Inhibition of GHR mRNA by 5-10-5 MOE gapmers targeting introns 3-8 of SEQ ID NO: 2

| ISIS NO | Sequence | Target Region | % inhibition | SEQ ID NO: 2 Start Site | SEQ ID NO: 2 Stop Site | SEQ ID NO |
|---|---|---|---|---|---|---|
| 532581 | CATACCAGTCTCCTCGCTCA | Intron 5 | 0 | 276738 | 276757 | 1343 |
| 532582 | ATATAACAGAATCCAACCAT | Intron 5 | 47 | 277045 278361 | 277064 278380 | 1344 |
| 532583 | TGCAAAATGGCCAAACTACA | Intron 5 | 56 | 277577 | 277596 | 1345 |
| 532584 | TCTTCCTAGCCACATGTGAT | Intron 5 | 32 | 278227 | 278246 | 1346 |
| 532585 | TACCATGCTCTCTAATTGCC | Intron 6 | 47 | 279624 | 279643 | 1347 |
| 532586 | AGTGATCTGTGCCAGGCTGC | Intron 6 | 65 | 279848 | 279867 | 1348 |
| 532587 | AAGTTACAGAACAGATATCT | Intron 6 | 61 | 280012 | 280031 | 1349 |
| 532588 | GTATTGTGAAAATAGTACTG | Intron 6 | 45 | 280226 | 280245 | 1350 |
| 532589 | AAACACTATCAAGCTCACGG | Intron 6 | 54 | 280807 | 280826 | 1351 |
| 532590 | TTCAAGAAAAGTCTTCAAAT | Intron 6 | 24 | 280831 | 280850 | 1352 |
| 532591 | GGATCATTTCCCCATGCATG | Intron 6 | 52 | 280982 | 281001 | 1353 |
| 532592 | ATATTATATTAAGAAAAATG | Intron 6 | 4 | 281422 | 281441 | 1354 |
| 532593 | CTCCCATGTTCATTACTTAT | Intron 6 | 49 | 281587 | 281606 | 1355 |
| 532594 | CATGACATTGGTTTGGGCAA | Intron 6 | 43 | 282229 | 282248 | 1356 |
| 532595 | AATGTTGTTGGGAAAATTGG | Intron 6 | 42 | 282383 | 282402 | 1357 |
| 532596 | AGCTGCAGGATACAAAGTCA | Intron 6 | 49 | 282986 | 283005 | 1358 |
| 532597 | ATATCCTTTCATGATAAAAA | Intron 6 | 31 | 283354 | 283373 | 1359 |
| 532598 | ATGGGCTAATATCTCTGATA | Intron 6 | 50 | 283590 | 283609 | 1360 |
| 532599 | ACATTACTAATAATTAGAGA | Intron 6 | 0 | 285236 | 285255 | 1361 |
| 532600 | ATAAAAACATATGAAAGTAT | Intron 6 | 12 | 287093 | 287112 | 1362 |
| 532601 | TTCTGAATTAAATCTATTAG | Intron 6 | 16 | 287408 | 287427 | 1363 |
| 532602 | TTACATTTTTGCAAATTTAT | Intron 6 | 31 | 287472 | 287491 | 1364 |
| 532603 | TGAACAGTTGATTAACAAAG | Intron 6 | 15 | 287887 | 287906 | 1365 |
| 532604 | AAGTTATTGGTTTACTAGAT | Intron 6 | 0 | 288598 | 288617 | 1366 |
| 532605 | TTGGAAAAGGTCCTAGAAAA | Intron 6 | 24 | 289808 | 289827 | 1367 |
| 532606 | CATGACAGAAACTTCTTAGA | Intron 7 | 25 | 292035 | 292054 | 1368 |
| 532607 | CCATACTTGCTGACAAATAT | Intron 8 | 39 | 294389 | 294408 | 1369 |

Example 115

Dose-Dependent Antisense Inhibition of Human GHR in Hep3B Cells by MOE Gapmers

Gapmers from the studies described above exhibiting significant in vitro inhibition of GHR mRNA were selected and tested at various doses in Hep3B cells. The antisense oligonucleotides were tested in a series of experiments that had similar culture conditions. The results for each experiment are presented in separate tables shown below. Cells were plated at a density of 20,000 cells per well and transfected using electroporation with 0.625 µM, 1.25 µM, 2.50 µM, 5.00 µM and 10.00 µM concentrations of antisense oligonucleotide, as specified in the Tables below. After a treatment period of approximately 16 hours, RNA was isolated from the cells and GHR mRNA levels were measured by quantitative real-time PCR. Human primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration (IC$_{50}$) of each oligonucleotide is also presented. GHR mRNA levels were significantly reduced in a dose-dependent manner in antisense oligonucleotide treated cells.

TABLE 141

| ISIS No | 0.625 µM | 1.250 µM | 2.50 µM | 5.00 µM | 10.00 µM | IC$_{50}$ (µM) |
|---|---|---|---|---|---|---|
| 523271 | 41 | 61 | 73 | 86 | 92 | 0.8 |
| 523274 | 20 | 36 | 64 | 80 | 92 | 1.8 |
| 523324 | 35 | 45 | 68 | 91 | 90 | 1.2 |

TABLE 142

| ISIS No | 0.625 µM | 1.250 µM | 2.50 µM | 5.00 µM | 10.00 µM | IC$_{50}$ (µM) |
|---|---|---|---|---|---|---|
| 523604 | 21 | 42 | 68 | 58 | 86 | 2.0 |
| 523577 | 6 | 22 | 56 | 66 | 91 | 2.7 |
| 523614 | 14 | 44 | 61 | 84 | 87 | 1.9 |
| 523564 | 4 | 26 | 48 | 67 | 86 | 2.8 |
| 523633 | 30 | 43 | 71 | 82 | 84 | 1.4 |
| 523571 | 2 | 9 | 38 | 55 | 82 | 3.9 |

TABLE 143

| ISIS No | 0.625 µM | 1.250 µM | 2.50 µM | 5.00 µM | 10.00 µM | IC$_{50}$ (µM) |
|---|---|---|---|---|---|---|
| 523570 | 25 | 50 | 64 | 77 | 88 | 1.5 |
| 523592 | 27 | 42 | 59 | 79 | 88 | 1.7 |
| 523595 | 21 | 50 | 62 | 76 | 90 | 1.6 |
| 523596 | 36 | 47 | 62 | 75 | 77 | 1.4 |
| 523607 | 49 | 62 | 71 | 82 | 84 | 0.5 |
| 523615 | 20 | 49 | 63 | 83 | 91 | 1.6 |
| 523630 | 4 | 28 | 54 | 79 | 78 | 2.6 |
| 523661 | 4 | 34 | 48 | 73 | 79 | 2.7 |
| 523665 | 4 | 28 | 54 | 73 | 79 | 2.7 |
| 523687 | 30 | 56 | 61 | 78 | 81 | 1.4 |
| 523711 | 42 | 66 | 78 | 94 | 95 | 0.7 |
| 523712 | 6 | 37 | 60 | 72 | 89 | 2.3 |
| 523713 | 4 | 32 | 55 | 72 | 85 | 2.5 |
| 523714 | 59 | 75 | 88 | 95 | 97 | 0.2 |

TABLE 144

| ISIS No | 0.625 µM | 1.250 µM | 2.50 µM | 5.00 µM | 10.00 µM | IC$_{50}$ (µM) |
|---|---|---|---|---|---|---|
| 523655 | 26 | 33 | 60 | 67 | 78 | 2.1 |
| 523656 | 19 | 33 | 45 | 69 | 87 | 2.4 |
| 523658 | 0 | 42 | 62 | 67 | 79 | 3.1 |
| 523715 | 78 | 90 | 92 | 93 | 95 | <0.6 |
| 523718 | 30 | 46 | 67 | 84 | 92 | 1.4 |
| 523723 | 56 | 69 | 83 | 92 | 94 | 0.3 |
| 523725 | 45 | 64 | 79 | 89 | 95 | 0.6 |
| 523726 | 32 | 48 | 77 | 88 | 89 | 1.2 |
| 523736 | 0 | 64 | 75 | 90 | 96 | 1.5 |
| 523747 | 48 | 64 | 80 | 91 | 92 | 0.6 |
| 523758 | 25 | 39 | 61 | 74 | 84 | 1.9 |
| 523766 | 7 | 37 | 66 | 81 | 93 | 2.0 |
| 523776 | 26 | 54 | 72 | 78 | 83 | 1.3 |
| 523789 | 62 | 68 | 81 | 85 | 90 | 0.2 |

TABLE 145

| ISIS No | 0.625 µM | 1.250 µM | 2.50 µM | 5.00 µM | 10.00 µM | IC$_{50}$ (µM) |
|---|---|---|---|---|---|---|
| 523719 | 24 | 46 | 65 | 84 | 93 | 1.5 |
| 523720 | 18 | 49 | 72 | 85 | 93 | 1.5 |
| 523724 | 43 | 61 | 77 | 91 | 91 | 0.7 |
| 523735 | 8 | 42 | 63 | 81 | 93 | 2.0 |
| 523740 | 37 | 58 | 72 | 83 | 88 | 1.0 |
| 523752 | 9 | 29 | 52 | 72 | 86 | 2.5 |
| 523763 | 8 | 32 | 57 | 70 | 80 | 2.6 |
| 523764 | 43 | 52 | 67 | 77 | 79 | 0.9 |
| 523765 | 24 | 48 | 62 | 88 | 4 | 1.5 |
| 523767 | 49 | 62 | 67 | 72 | 82 | 0.6 |
| 523772 | 29 | 39 | 54 | 62 | 61 | 2.7 |
| 523774 | 28 | 59 | 63 | 88 | 91 | 1.2 |
| 523778 | 25 | 32 | 63 | 78 | 84 | 1.9 |
| 523783 | 0 | 22 | 53 | 72 | 88 | 2.8 |

TABLE 146

| ISIS No | 0.625 µM | 1.250 µM | 2.50 µM | 5.00 µM | 10.00 µM | IC$_{50}$ (µM) |
|---|---|---|---|---|---|---|
| 532151 | 57 | 69 | 76 | 85 | 88 | <0.6 |
| 532153 | 23 | 43 | 54 | 80 | 86 | 1.8 |
| 532158 | 46 | 58 | 81 | 87 | 87 | 0.6 |
| 532160 | 17 | 26 | 55 | 76 | 92 | 2.2 |
| 532162 | 14 | 46 | 71 | 83 | 93 | 1.7 |
| 532164 | 37 | 76 | 82 | 90 | 93 | 0.6 |
| 532171 | 41 | 81 | 67 | 81 | 83 | <0.6 |
| 532181 | 56 | 81 | 84 | 89 | 93 | 0.2 |
| 532186 | 26 | 65 | 75 | 83 | 91 | 1.1 |
| 532188 | 51 | 68 | 80 | 89 | 93 | <0.6 |
| 532189 | 24 | 31 | 52 | 75 | 86 | 2.1 |
| 532197 | 0 | 40 | 66 | 85 | 93 | 2.1 |
| 532199 | 24 | 37 | 50 | 73 | 87 | 2.1 |
| 532222 | 12 | 41 | 67 | 84 | 94 | 1.8 |

TABLE 147

| ISIS No | 0.625 µM | 1.250 µM | 2.50 µM | 5.00 µM | 10.00 µM | IC$_{50}$ (µM) |
|---|---|---|---|---|---|---|
| 532175 | 41 | 54 | 76 | 84 | 89 | 0.9 |
| 532223 | 53 | 69 | 75 | 88 | 94 | <0.6 |
| 532235 | 43 | 58 | 67 | 77 | 82 | 0.8 |
| 532241 | 39 | 53 | 62 | 73 | 87 | 1.2 |
| 532248 | 49 | 65 | 72 | 85 | 93 | 0.6 |
| 532254 | 52 | 62 | 85 | 87 | 92 | <0.6 |
| 532300 | 20 | 29 | 49 | 66 | 78 | 2.7 |
| 532304 | 26 | 39 | 66 | 78 | 90 | 1.7 |
| 532316 | 41 | 66 | 76 | 86 | 94 | 0.7 |
| 532395 | 32 | 56 | 84 | 93 | 97 | 1.0 |
| 532401 | 47 | 80 | 92 | 96 | 98 | <0.6 |
| 532411 | 73 | 90 | 94 | 97 | 98 | <0.6 |
| 532420 | 38 | 49 | 82 | 85 | 97 | 1.0 |
| 532436 | 37 | 58 | 75 | 90 | 96 | 0.9 |

TABLE 148

| ISIS No | 0.625 µM | 1.250 µM | 2.50 µM | 5.00 µM | 10.00 µM | IC$_{50}$ (µM) |
|---|---|---|---|---|---|---|
| 532410 | 66 | 83 | 92 | 94 | 97 | <0.6 |
| 532468 | 45 | 68 | 78 | 93 | 94 | 0.6 |
| 532469 | 0 | 17 | 56 | 76 | 92 | 2.8 |
| 532470 | 10 | 34 | 62 | 84 | 94 | 2.0 |
| 532475 | 13 | 36 | 52 | 64 | 87 | 2.5 |
| 532476 | 34 | 64 | 73 | 79 | 93 | 0.9 |
| 532480 | 28 | 54 | 67 | 78 | 87 | 1.4 |
| 532482 | 21 | 39 | 69 | 83 | 92 | 1.7 |
| 532490 | 42 | 60 | 68 | 84 | 93 | 0.9 |
| 532500 | 37 | 50 | 63 | 81 | 87 | 1.2 |

TABLE 148-continued

| ISIS No | 0.625 µM | 1.250 µM | 2.50 µM | 5.00 µM | 10.00 µM | IC$_{50}$ (µM) |
|---|---|---|---|---|---|---|
| 532506 | 13 | 41 | 66 | 75 | 89 | 1.9 |
| 532507 | 47 | 59 | 71 | 86 | 89 | 0.7 |
| 532508 | 0 | 31 | 73 | 83 | 89 | 2.2 |
| 532526 | 31 | 56 | 78 | 79 | 88 | 1.1 |

TABLE 149

| ISIS No | 0.625 µM | 1.250 µM | 2.50 µM | 5.00 µM | 10.00 µM | IC$_{50}$ (µM) |
|---|---|---|---|---|---|---|
| 532495 | 59 | 74 | 81 | 87 | 95 | <0.6 |
| 532501 | 49 | 53 | 71 | 83 | 84 | 0.7 |
| 532534 | 53 | 75 | 85 | 91 | 97 | <0.6 |
| 532535 | 0 | 34 | 61 | 84 | 92 | 2.6 |
| 532537 | 49 | 67 | 80 | 90 | 94 | <0.6 |
| 532540 | 59 | 70 | 87 | 93 | 95 | <0.6 |
| 532547 | 57 | 71 | 81 | 91 | 92 | <0.6 |
| 532555 | 48 | 36 | 61 | 72 | 85 | 1.3 |
| 532556 | 33 | 57 | 67 | 86 | 90 | 1.1 |

TABLE 150

| ISIS No | 0.625 µM | 1.250 µM | 2.50 µM | 5.00 µM | 10.00 µM | IC$_{50}$ (µM) |
|---|---|---|---|---|---|---|
| 523421 | 32 | 57 | 81 | 82 | 88 | 1.0 |
| 533006 | 46 | 43 | 69 | 83 | 91 | 1.0 |
| 533121 | 53 | 75 | 75 | 88 | 93 | <0.6 |
| 533122 | 65 | 77 | 82 | 90 | 93 | <0.6 |
| 533123 | 39 | 71 | 84 | 91 | 95 | 0.6 |
| 533125 | 49 | 61 | 81 | 85 | 91 | 0.6 |
| 533131 | 3 | 57 | 59 | 82 | 90 | 1.9 |
| 533136 | 32 | 65 | 62 | 81 | 88 | 1.1 |
| 533139 | 13 | 51 | 72 | 90 | 94 | 1.5 |
| 533140 | 36 | 66 | 39 | 87 | 92 | 1.2 |
| 533153 | 50 | 65 | 83 | 89 | 90 | <0.6 |
| 533156 | 43 | 64 | 74 | 85 | 90 | 0.7 |
| 533160 | 57 | 80 | 87 | 91 | 95 | <0.6 |
| 533161 | 54 | 62 | 81 | 89 | 92 | <0.6 |

TABLE 151

| ISIS No | 0.625 µM | 1.250 µM | 2.50 µM | 5.00 µM | 10.00 µM | IC$_{50}$ (µM) |
|---|---|---|---|---|---|---|
| 533234 | 50 | 70 | 86 | 93 | 95 | <0.6 |
| 533237 | 5 | 45 | 63 | 84 | 93 | 1.9 |
| 533233 | 43 | 55 | 76 | 90 | 95 | 0.8 |
| 533179 | 31 | 63 | 75 | 87 | 87 | 1.0 |
| 533178 | 53 | 67 | 76 | 89 | 94 | <0.6 |
| 533187 | 5 | 15 | 53 | 79 | 86 | 2.7 |
| 533188 | 49 | 68 | 83 | 89 | 94 | <0.6 |
| 533271 | 45 | 66 | 85 | 92 | 94 | 0.6 |
| 533134 | 22 | 45 | 64 | 81 | 89 | 1.6 |
| 533258 | 52 | 72 | 88 | 93 | 95 | <0.6 |
| 533235 | 50 | 54 | 75 | 82 | 90 | 0.7 |
| 533262 | 23 | 54 | 78 | 91 | 96 | 1.2 |
| 533189 | 48 | 66 | 78 | 82 | 88 | <0.6 |
| 533193 | 38 | 53 | 72 | 77 | 91 | 1.0 |

TABLE 152

| ISIS No | 0.625 µM | 1.250 µM | 2.50 µM | 5.00 µM | 10.00 µM | IC$_{50}$ (µM) |
|---|---|---|---|---|---|---|
| 533259 | 63 | 78 | 84 | 90 | 92 | <0.6 |
| 533291 | 25 | 57 | 75 | 86 | 96 | 1.2 |
| 533256 | 67 | 76 | 90 | 95 | 95 | <0.6 |

TABLE 152-continued

| ISIS No | 0.625 µM | 1.250 µM | 2.50 µM | 5.00 µM | 10.00 µM | IC$_{50}$ (µM) |
|---|---|---|---|---|---|---|
| 533269 | 42 | 75 | 82 | 94 | 97 | 0.6 |
| 533265 | 67 | 78 | 91 | 95 | 97 | <0.6 |
| 533318 | 16 | 45 | 77 | 87 | 95 | 1.5 |
| 533257 | 55 | 84 | 91 | 96 | 96 | <0.6 |
| 533280 | 34 | 62 | 80 | 91 | 91 | 0.9 |
| 533301 | 52 | 77 | 84 | 93 | 96 | <0.6 |
| 533316 | 41 | 50 | 79 | 93 | 94 | 0.9 |
| 533270 | 62 | 71 | 88 | 94 | 97 | <0.6 |
| 533330 | 46 | 76 | 93 | 97 | 98 | <0.6 |
| 533317 | 55 | 60 | 82 | 87 | 96 | <0.6 |
| 533315 | 39 | 56 | 82 | 87 | 93 | 0.9 |

TABLE 153

| ISIS No | 0.625 µM | 1.250 µM | 2.50 µM | 5.00 µM | 10.00 µM | IC$_{50}$ (µM) |
|---|---|---|---|---|---|---|
| 533364 | 71 | 77 | 92 | 90 | 94 | <0.6 |
| 533925 | 26 | 55 | 61 | 85 | 91 | 1.4 |
| 533326 | 54 | 77 | 80 | 93 | 95 | <0.6 |
| 533916 | 18 | 62 | 69 | 83 | 93 | 1.4 |
| 533328 | 52 | 68 | 89 | 94 | 98 | <0.6 |
| 533932 | 42 | 49 | 80 | 86 | 92 | 0.9 |
| 533352 | 42 | 82 | 88 | 93 | 94 | <0.6 |
| 533917 | 20 | 37 | 57 | 78 | 84 | 2.0 |
| 533331 | 54 | 83 | 89 | 93 | 96 | <0.6 |
| 533936 | 21 | 46 | 73 | 84 | 88 | 1.5 |
| 533329 | 56 | 73 | 84 | 92 | 98 | <0.6 |
| 533937 | 26 | 32 | 79 | 86 | 94 | 1.5 |
| 533908 | 58 | 66 | 81 | 88 | 94 | <0.6 |
| 533898 | 61 | 64 | 84 | 90 | 92 | <0.6 |

TABLE 154

| ISIS No | 0.625 µM | 1.250 µM | 2.50 µM | 5.00 µM | 10.00 µM | IC$_{50}$ (µM) |
|---|---|---|---|---|---|---|
| 539371 | 32 | 41 | 82 | 92 | 98 | 1.2 |
| 539382 | 18 | 58 | 74 | 91 | 97 | 1.3 |
| 539392 | 34 | 59 | 79 | 94 | 96 | 0.9 |
| 539398 | 31 | 53 | 89 | 94 | 98 | 1.0 |
| 539399 | 31 | 72 | 87 | 95 | 97 | 0.8 |
| 539400 | 36 | 60 | 79 | 93 | 97 | 0.9 |
| 539405 | 33 | 58 | 74 | 91 | 94 | 1.0 |
| 539412 | 23 | 61 | 80 | 93 | 95 | 1.1 |
| 539413 | 53 | 75 | 86 | 92 | 96 | <0.6 |
| 539415 | 47 | 62 | 84 | 91 | 96 | 0.6 |
| 539416 | 61 | 85 | 94 | 97 | 96 | <0.6 |
| 539430 | 24 | 48 | 68 | 80 | 93 | 1.5 |
| 539431 | 14 | 40 | 71 | 89 | 95 | 1.7 |
| 539433 | 46 | 67 | 74 | 92 | 95 | 0.6 |

Example 116

Dose-Dependent Antisense Inhibition of Human GHR in Hep3B Cells by MOE Gapmers

Gapmers from the studies described above exhibiting significant in vitro inhibition of GHR mRNA were selected and tested at various doses in Hep3B cells. The antisense oligonucleotides were tested in a series of experiments that had similar culture conditions. The results for each experiment are presented in separate tables shown below. Cells were plated at a density of 20,000 cells per well and transfected using electroporation with 0.3125 µM, 0.625 µM, 1.25 µM, 2.50 µM, 5.00 µM and 10.00 µM concentrations of antisense oligonucleotide, as specified in the Tables below. After a treatment period of approximately 16 hours, RNA was isolated from the cells and GHR mRNA levels were measured by quantitative real-time PCR. Human primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration ($IC_{50}$) of each oligonucleotide is also presented. GHR mRNA levels were significantly reduced in a dose-dependent manner in antisense oligonucleotide treated cells.

TABLE 155

| ISIS No | 0.3125 µM | 0.625 µM | 1.250 µM | 2.50 µM | 5.00 µM | 10.00 µM | $IC_{50}$ (µM) |
|---|---|---|---|---|---|---|---|
| 523814 | 0 | 24 | 48 | 52 | 68 | 82 | 2.2 |
| 523805 | 13 | 29 | 55 | 0 | 79 | 85 | 1.5 |
| 523822 | 0 | 19 | 26 | 41 | 65 | 85 | 2.8 |
| 523820 | 0 | 19 | 29 | 58 | 74 | 86 | 2.3 |
| 523815 | 3 | 6 | 19 | 37 | 45 | 71 | 4.8 |
| 523828 | 12 | 19 | 32 | 51 | 64 | 74 | 2.7 |
| 523801 | 3 | 9 | 31 | 43 | 59 | 76 | 3.3 |
| 523824 | 12 | 28 | 44 | 63 | 77 | 85 | 1.7 |
| 523794 | 13 | 21 | 30 | 51 | 66 | 78 | 2.5 |
| 523810 | 15 | 34 | 55 | 72 | 78 | 86 | 1.3 |
| 523819 | 0 | 24 | 40 | 60 | 66 | 75 | 2.4 |

TABLE 156

| ISIS No | 0.3125 µM | 0.625 µM | 1.250 µM | 2.50 µM | 5.00 µM | 10.00 µM | $IC_{50}$ (µM) |
|---|---|---|---|---|---|---|---|
| 539302 | 31 | 56 | 80 | 92 | 97 | 98 | 0.5 |
| 539314 | 16 | 28 | 49 | 69 | 85 | 95 | 1.3 |
| 539319 | 8 | 30 | 45 | 71 | 90 | 94 | 1.4 |
| 539320 | 11 | 42 | 64 | 83 | 92 | 95 | 1.0 |
| 539321 | 25 | 48 | 64 | 82 | 95 | 97 | 0.8 |
| 539322 | 19 | 34 | 58 | 72 | 90 | 96 | 1.1 |
| 539331 | 7 | 14 | 46 | 69 | 88 | 96 | 1.6 |
| 539355 | 28 | 35 | 67 | 89 | 96 | 98 | 0.8 |
| 539358 | 12 | 39 | 56 | 80 | 93 | 98 | 1.1 |
| 539359 | 15 | 23 | 58 | 77 | 93 | 98 | 1.2 |

TABLE 157

| ISIS No | 0.3125 µM | 0.625 µM | 1.250 µM | 2.50 µM | 5.00 µM | 10.00 µM | $IC_{50}$ (µM) |
|---|---|---|---|---|---|---|---|
| 539318 | 23 | 21 | 56 | 73 | 88 | 94 | 1.2 |
| 539325 | 14 | 26 | 38 | 74 | 92 | 98 | 1.4 |
| 539339 | 18 | 23 | 58 | 83 | 92 | 98 | 1.1 |
| 539341 | 17 | 29 | 62 | 84 | 94 | 95 | 1.0 |
| 539342 | 20 | 31 | 43 | 71 | 90 | 95 | 1.2 |
| 539352 | 15 | 23 | 41 | 61 | 89 | 95 | 1.5 |
| 539356 | 24 | 46 | 62 | 83 | 90 | 97 | 0.8 |
| 539361 | 37 | 42 | 73 | 88 | 96 | 98 | 0.6 |
| 539379 | 53 | 66 | 83 | 96 | 96 | 98 | 0.2 |
| 539380 | 52 | 77 | 91 | 97 | 97 | 99 | 0.1 |
| 539383 | 34 | 61 | 71 | 89 | 98 | 98 | 0.5 |

TABLE 158

| ISIS No | 0.3125 µM | 0.625 µM | 1.250 µM | 2.50 µM | 5.00 µM | 10.00 µM | $IC_{50}$ (µM) |
|---|---|---|---|---|---|---|---|
| 539360 | 45 | 60 | 81 | 94 | 97 | 98 | 0.3 |
| 539362 | 21 | 36 | 72 | 90 | 98 | 99 | 0.8 |
| 539375 | 23 | 36 | 66 | 85 | 95 | 99 | 0.9 |
| 539376 | 26 | 35 | 58 | 82 | 95 | 99 | 0.9 |
| 539377 | 29 | 31 | 43 | 64 | 85 | 89 | 1.3 |
| 539378 | 37 | 59 | 81 | 93 | 97 | 98 | 0.4 |
| 539389 | 34 | 61 | 61 | 87 | 95 | 97 | 0.5 |
| 539401 | 34 | 52 | 63 | 84 | 92 | 95 | 0.6 |
| 539403 | 52 | 73 | 83 | 94 | 97 | 98 | 0.1 |
| 539404 | 22 | 55 | 74 | 88 | 94 | 96 | 0.6 |
| 539432 | 32 | 50 | 75 | 86 | 94 | 96 | 0.6 |

Example 117

Dose-Dependent Antisense Inhibition of Human GHR in Hep3B Cells by MOE Gapmers

Gapmers from studies described above exhibiting significant in vitro inhibition of GHR mRNA were selected and tested at various doses in Hep3B cells. The antisense oligonucleotides were tested in a series of experiments that had similar culture conditions. The results for each experiment are presented in separate tables shown below. Cells were plated at a density of 20,000 cells per well and transfected using electroporation with 0.625 µM, 1.25 µM, 2.50 µM, 5.00 µM and 10.00 µM concentrations of antisense oligonucleotide, as specified in the Tables below. After a treatment period of approximately 16 hours, RNA was isolated from the cells and GHR mRNA levels were measured by quantitative real-time PCR. Human primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration ($IC_{50}$) of each oligonucleotide is also presented. GHR mRNA levels were significantly reduced in a dose-dependent manner in antisense oligonucleotide treated cells.

TABLE 159

| ISIS No | 0.625 µM | 1.250 µM | 2.50 µM | 5.00 µM | 10.00 µM | $IC_{50}$ (µM) |
|---|---|---|---|---|---|---|
| 523271 | 26 | 41 | 80 | 89 | 94 | 1.4 |
| 523274 | 13 | 35 | 63 | 85 | 95 | 1.9 |
| 523324 | 26 | 40 | 64 | 88 | 95 | 1.6 |
| 523577 | 27 | 50 | 72 | 87 | 95 | 1.3 |
| 523604 | 49 | 66 | 74 | 81 | 87 | 0.5 |
| 523614 | 43 | 54 | 82 | 92 | 89 | 0.8 |

TABLE 160

| ISIS No | 0.625 µM | 1.250 µM | 2.50 µM | 5.00 µM | 10.00 µM | $IC_{50}$ (µM) |
|---|---|---|---|---|---|---|
| 523564 | 16 | 48 | 69 | 75 | 91 | 1.7 |
| 523570 | 24 | 52 | 65 | 71 | 88 | 1.6 |
| 523592 | 6 | 31 | 52 | 65 | 81 | 2.8 |
| 523595 | 13 | 49 | 60 | 79 | 92 | 1.8 |
| 523596 | 20 | 49 | 62 | 71 | 75 | 1.9 |
| 523607 | 38 | 63 | 66 | 74 | 76 | 0.8 |
| 523615 | 17 | 48 | 60 | 80 | 92 | 1.8 |
| 523630 | 19 | 42 | 42 | 67 | 80 | 2.5 |
| 523633 | 41 | 69 | 78 | 79 | 80 | 0.6 |
| 523665 | 16 | 45 | 56 | 71 | 80 | 2.1 |

TABLE 160-continued

| ISIS No | 0.625 μM | 1.250 μM | 2.50 μM | 5.00 μM | 10.00 μM | IC$_{50}$ (μM) |
|---|---|---|---|---|---|---|
| 523687 | 37 | 59 | 73 | 75 | 78 | 0.9 |
| 523711 | 33 | 63 | 78 | 91 | 93 | 0.9 |
| 523712 | 13 | 36 | 61 | 78 | 87 | 2.1 |
| 523714 | 63 | 85 | 91 | 96 | 96 | <0.6 |

TABLE 161

| ISIS No | 0.625 μM | 1.250 μM | 2.50 μM | 5.00 μM | 10.00 μM | IC$_{50}$ (μM) |
|---|---|---|---|---|---|---|
| 523655 | 28 | 42 | 57 | 74 | 76 | 1.9 |
| 523656 | 33 | 43 | 53 | 74 | 88 | 1.7 |
| 523661 | 29 | 29 | 66 | 79 | 82 | 1.9 |
| 523713 | 35 | 45 | 64 | 83 | 87 | 1.3 |
| 523715 | 83 | 86 | 92 | 93 | 94 | <0.6 |
| 523718 | 27 | 52 | 69 | 84 | 95 | 1.3 |
| 523723 | 65 | 74 | 86 | 85 | 94 | <0.6 |
| 523725 | 37 | 63 | 78 | 78 | 92 | 0.8 |
| 523726 | 43 | 57 | 72 | 86 | 89 | 0.8 |
| 523736 | 39 | 65 | 80 | 88 | 95 | 0.8 |
| 523747 | 51 | 71 | 83 | 86 | 93 | <0.6 |
| 523766 | 30 | 50 | 70 | 82 | 89 | 1.3 |
| 523776 | 45 | 59 | 67 | 79 | 84 | 0.7 |
| 523789 | 63 | 75 | 76 | 83 | 83 | <0.6 |

TABLE 162

| ISIS No | 0.625 μM | 1.250 μM | 2.50 μM | 5.00 μM | 10.00 μM | IC$_{50}$ (μM) |
|---|---|---|---|---|---|---|
| 523719 | 18 | 40 | 56 | 73 | 83 | 2.1 |
| 523720 | 36 | 46 | 59 | 64 | 89 | 1.5 |
| 523724 | 44 | 60 | 75 | 81 | 87 | 0.7 |
| 523735 | 11 | 40 | 60 | 78 | 84 | 2.1 |
| 523740 | 17 | 47 | 61 | 80 | 81 | 1.8 |
| 523752 | 25 | 31 | 38 | 70 | 84 | 2.5 |
| 523758 | 23 | 48 | 58 | 72 | 80 | 1.8 |
| 523763 | 2 | 24 | 48 | 64 | 75 | 3.3 |
| 523764 | 22 | 49 | 45 | 73 | 75 | 2.1 |
| 523765 | 42 | 40 | 57 | 79 | 87 | 1.4 |
| 523767 | 43 | 53 | 56 | 69 | 79 | 1.2 |
| 523774 | 36 | 52 | 71 | 81 | 89 | 1.1 |
| 523778 | 15 | 45 | 59 | 75 | 79 | 2.0 |
| 523783 | 5 | 30 | 48 | 66 | 83 | 2.9 |

TABLE 163

| ISIS No | 0.625 μM | 1.250 μM | 2.50 μM | 5.00 μM | 10.00 μM | IC$_{50}$ (μM) |
|---|---|---|---|---|---|---|
| 532151 | 40 | 45 | 64 | 71 | 82 | 1.3 |
| 532158 | 28 | 47 | 63 | 70 | 87 | 1.6 |
| 532164 | 36 | 47 | 64 | 75 | 89 | 1.3 |
| 532171 | 35 | 47 | 50 | 69 | 89 | 1.6 |
| 532175 | 27 | 38 | 43 | 75 | 87 | 2.1 |
| 532181 | 21 | 56 | 63 | 69 | 80 | 1.7 |
| 532186 | 28 | 49 | 62 | 73 | 91 | 1.5 |
| 532188 | 40 | 52 | 73 | 75 | 90 | 1.0 |
| 532223 | 22 | 34 | 53 | 71 | 90 | 2.2 |
| 532235 | 35 | 31 | 48 | 68 | 73 | 2.3 |
| 532241 | 6 | 24 | 29 | 51 | 72 | 4.5 |
| 532248 | 19 | 37 | 47 | 73 | 84 | 2.3 |
| 532254 | 56 | 56 | 72 | 85 | 90 | 0.5 |
| 532316 | 32 | 55 | 50 | 78 | 90 | 1.5 |

TABLE 164

| ISIS No | 0.625 μM | 1.250 μM | 2.50 μM | 5.00 μM | 10.00 μM | IC$_{50}$ (μM) |
|---|---|---|---|---|---|---|
| 532304 | 44 | 57 | 68 | 78 | 73 | 0.7 |
| 532395 | 47 | 62 | 82 | 91 | 96 | 0.6 |
| 532401 | 70 | 83 | 91 | 94 | 96 | <0.6 |
| 532410 | 56 | 71 | 85 | 90 | 96 | <0.6 |
| 532411 | 88 | 93 | 96 | 97 | 98 | <0.6 |
| 532420 | 61 | 67 | 82 | 85 | 96 | <0.6 |
| 532436 | 48 | 49 | 77 | 90 | 97 | 0.8 |
| 532468 | 42 | 67 | 82 | 89 | 94 | 0.6 |
| 532476 | 32 | 58 | 75 | 84 | 90 | 1.1 |
| 532482 | 5 | 26 | 56 | 71 | 87 | 2.6 |
| 532490 | 18 | 47 | 55 | 69 | 86 | 2.0 |
| 532501 | 4 | 22 | 43 | 59 | 77 | 3.5 |
| 532507 | 39 | 63 | 66 | 83 | 89 | 0.9 |
| 532526 | 30 | 48 | 67 | 82 | 88 | 1.4 |

TABLE 165

| ISIS No | 0.625 μM | 1.250 μM | 2.50 μM | 5.00 μM | 10.00 μM | IC$_{50}$ (μM) |
|---|---|---|---|---|---|---|
| 533121 | 59 | 67 | 78 | 83 | 87 | 0.2 |
| 533122 | 48 | 73 | 78 | 84 | 90 | 0.4 |
| 533125 | 47 | 61 | 74 | 89 | 89 | 0.6 |
| 533136 | 5 | 25 | 58 | 79 | 90 | 2.4 |
| 533156 | 37 | 48 | 69 | 77 | 87 | 1.2 |
| 533161 | 28 | 67 | 77 | 89 | 90 | 1.0 |
| 533178 | 30 | 60 | 72 | 90 | 92 | 1.1 |
| 533179 | 37 | 66 | 76 | 76 | 87 | 0.8 |
| 533188 | 32 | 64 | 74 | 80 | 90 | 1.0 |
| 533189 | 49 | 66 | 77 | 81 | 81 | 0.4 |
| 533193 | 26 | 48 | 69 | 75 | 85 | 1.5 |
| 533233 | 39 | 60 | 59 | 84 | 93 | 1.0 |
| 533234 | 45 | 69 | 84 | 91 | 94 | 0.5 |
| 533235 | 28 | 49 | 69 | 82 | 90 | 1.4 |

TABLE 166

| ISIS No | 0.625 μM | 1.250 μM | 2.50 μM | 5.00 μM | 10.00 μM | IC$_{50}$ (μM) |
|---|---|---|---|---|---|---|
| 533256 | 47 | 72 | 86 | 90 | 94 | <0.6 |
| 533257 | 63 | 77 | 88 | 91 | 96 | <0.6 |
| 533258 | 66 | 81 | 88 | 95 | 95 | <0.6 |
| 533259 | 48 | 70 | 84 | 90 | 93 | <0.6 |
| 533262 | 44 | 66 | 79 | 90 | 96 | 0.7 |
| 533265 | 59 | 74 | 85 | 93 | 96 | <0.6 |
| 533269 | 25 | 55 | 74 | 86 | 87 | 1.2 |
| 533270 | 34 | 59 | 73 | 86 | 95 | 1.0 |
| 533271 | 63 | 82 | 88 | 92 | 92 | <0.6 |
| 533291 | 14 | 46 | 64 | 84 | 89 | 1.8 |
| 533301 | 49 | 61 | 75 | 83 | 91 | 0.6 |
| 533315 | 22 | 39 | 73 | 76 | 91 | 1.7 |
| 533317 | 26 | 53 | 68 | 85 | 94 | 1.3 |
| 533318 | 29 | 40 | 46 | 77 | 91 | 1.9 |

TABLE 167

| ISIS No | 0.625 μM | 1.250 μM | 2.50 μM | 5.00 μM | 10.00 μM | IC$_{50}$ (μM) |
|---|---|---|---|---|---|---|
| 533280 | 58 | 64 | 77 | 82 | 87 | 0.3 |
| 533316 | 35 | 55 | 68 | 87 | 91 | 1.1 |
| 533326 | 34 | 68 | 76 | 89 | 96 | 0.8 |
| 533328 | 54 | 55 | 79 | 83 | 92 | 0.5 |
| 533329 | 46 | 62 | 72 | 83 | 95 | 0.7 |
| 533330 | 56 | 75 | 83 | 91 | 94 | 0.3 |
| 533331 | 54 | 61 | 80 | 86 | 89 | 0.4 |
| 533352 | 54 | 62 | 79 | 83 | 89 | 0.4 |
| 533364 | 52 | 73 | 83 | 91 | 94 | 0.4 |
| 533898 | 17 | 47 | 63 | 78 | 87 | 1.8 |

TABLE 167-continued

| ISIS No | 0.625 μM | 1.250 μM | 2.50 μM | 5.00 μM | 10.00 μM | IC$_{50}$ (μM) |
|---|---|---|---|---|---|---|
| 533908 | 35 | 58 | 74 | 82 | 87 | 1 |
| 533916 | 22 | 46 | 72 | 78 | 88 | 1.6 |
| 533932 | 51 | 62 | 70 | 79 | 80 | 0.5 |
| 533937 | 20 | 40 | 61 | 79 | 85 | 1.9 |

Example 118

Dose-Dependent Antisense Inhibition of Human GHR in Hep3B Cells by MOE Gapmers

Gapmers from studies described above exhibiting significant in vitro inhibition of GHR mRNA were selected and tested at various doses in Hep3B cells. The antisense oligonucleotides were tested in a series of experiments that had similar culture conditions. The results for each experiment are presented in separate tables shown below. Cells were plated at a density of 20,000 cells per well and transfected using electroporation with 0.3125 μM, 0.625 μM, 1.25 μM, 2.50 μM, 5.00 μM and 10.00 μM concentrations of antisense oligonucleotide, as specified in the Tables below. After a treatment period of approximately 16 hours, RNA was isolated from the cells and GHR mRNA levels were measured by quantitative real-time PCR. Human primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration (IC$_{50}$) of each oligonucleotide is also presented. GHR mRNA levels were significantly reduced in a dose-dependent manner in antisense oligonucleotide treated cells.

TABLE 168

| ISIS No | 0.3125 μM | 0.625 μM | 1.250 μM | 2.50 μM | 5.00 μM | 10.00 μM | IC$_{50}$ (μM) |
|---|---|---|---|---|---|---|---|
| 523577 | 0 | 16 | 33 | 59 | 72 | 94 | 2.2 |
| 523633 | 15 | 33 | 66 | 73 | 82 | 86 | 1.1 |
| 523764 | 11 | 33 | 50 | 68 | 78 | 83 | 1.5 |
| 523794 | 12 | 30 | 33 | 56 | 76 | 82 | 1.9 |
| 523805 | 21 | 48 | 66 | 78 | 85 | 92 | 0.8 |
| 523810 | 18 | 36 | 61 | 80 | 89 | 90 | 1.0 |
| 523814 | 13 | 35 | 52 | 67 | 81 | 88 | 1.3 |
| 523819 | 11 | 30 | 57 | 72 | 81 | 89 | 1.3 |
| 523820 | 0 | 15 | 43 | 61 | 84 | 92 | 1.8 |
| 523824 | 21 | 27 | 59 | 72 | 84 | 90 | 1.2 |

TABLE 169

| ISIS No | 0.3125 μM | 0.625 μM | 1.250 μM | 2.50 μM | 5.00 μM | 10.00 μM | IC$_{50}$ (μM) |
|---|---|---|---|---|---|---|---|
| 539302 | 34 | 41 | 56 | 83 | 83 | 96 | 0.8 |
| 539321 | 30 | 32 | 76 | 73 | 80 | 94 | 0.8 |
| 539322 | 22 | 36 | 57 | 72 | 78 | 94 | 1.1 |
| 539355 | 23 | 42 | 48 | 72 | 71 | 88 | 1.2 |
| 539359 | 21 | 38 | 48 | 73 | 78 | 92 | 1.2 |
| 539320 | 14 | 32 | 53 | 72 | 82 | 91 | 1.3 |
| 539341 | 3 | 19 | 35 | 56 | 78 | 89 | 2.0 |
| 539342 | 6 | 18 | 33 | 51 | 70 | 83 | 2.3 |
| 539356 | 0 | 0 | 21 | 45 | 73 | 94 | 2.7 |
| 539358 | 0 | 15 | 23 | 50 | 52 | 91 | 2.9 |

TABLE 170

| ISIS No | 0.3125 μM | 0.625 μM | 1.250 μM | 2.50 μM | 5.00 μM | 10.00 μM | IC$_{50}$ (μM) |
|---|---|---|---|---|---|---|---|
| 539339 | 22 | 37 | 52 | 77 | 90 | 92 | 1.0 |
| 539360 | 28 | 49 | 72 | 82 | 95 | 97 | 0.7 |
| 539361 | 36 | 56 | 75 | 86 | 95 | 98 | 0.5 |
| 539362 | 24 | 26 | 63 | 77 | 91 | 97 | 1.0 |
| 539375 | 21 | 29 | 39 | 63 | 77 | 91 | 1.5 |
| 539378 | 8 | 42 | 64 | 85 | 92 | 97 | 1.0 |
| 539379 | 43 | 59 | 80 | 89 | 96 | 98 | 0.3 |
| 539380 | 61 | 73 | 90 | 95 | 98 | 98 | 0.1 |
| 539383 | 30 | 49 | 75 | 87 | 97 | 98 | 0.6 |
| 539403 | 48 | 55 | 75 | 85 | 94 | 96 | 0.3 |
| 539432 | 36 | 42 | 69 | 79 | 88 | 95 | 0.7 |

TABLE 171

| ISIS No | 0.3125 μM | 0.625 μM | 1.250 μM | 2.50 μM | 5.00 μM | 10.00 μM | IC$_{50}$ (μM) |
|---|---|---|---|---|---|---|---|
| 539376 | 34 | 46 | 62 | 82 | 94 | 98 | 0.7 |
| 539389 | 53 | 58 | 78 | 86 | 94 | 97 | 0.2 |
| 539392 | 1 | 19 | 26 | 68 | 81 | 94 | 1.9 |
| 539399 | 27 | 52 | 65 | 78 | 92 | 98 | 0.7 |
| 539400 | 7 | 26 | 43 | 59 | 88 | 95 | 1.6 |
| 539401 | 32 | 39 | 77 | 90 | 92 | 95 | 0.6 |
| 539404 | 22 | 59 | 77 | 87 | 93 | 95 | 0.6 |
| 539413 | 16 | 33 | 53 | 82 | 86 | 96 | 1.1 |
| 539415 | 4 | 44 | 56 | 74 | 81 | 94 | 1.2 |
| 539416 | 37 | 61 | 70 | 85 | 92 | 95 | 0.4 |
| 539433 | 31 | 52 | 70 | 85 | 87 | 94 | 0.6 |

Example 119

Antisense Inhibition of Human Growth Hormone Receptor in Hep3B Cells by Deoxy, MOE and (S)-cEt Gapmers Additional antisense oligonucleotides were designed targeting a growth hormone receptor (GHR) nucleic acid and were tested for their effects on GHR mRNA in vitro. The antisense oligonucleotides were tested in a series of experiments that had similar culture conditions. The results for each experiment are presented in separate tables shown below. Cultured Hep3B cells at a density of 20,000 cells per well were transfected using electroporation with 5,000 nM antisense oligonucleotide. After a treatment period of approximately 24 hours, RNA was isolated from the cells and GHR mRNA levels were measured by quantitative real-time PCR. Human primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The newly designed chimeric antisense oligonucleotides in the Tables below were designed as deoxy, MOE, and (S)-cEt gapmers. The deoxy, MOE and (S)-cEt oligonucleotides are 16 nucleosides in length wherein the nucleoside have either a MOE sugar modification, an (S)-cEt sugar modification, or a deoxy modification. The 'Chemistry' column describes the sugar modifications of each oligonucleotide. 'k' indicates an (S)-cEt sugar modification; indicates deoxyribose; and 'e' indicates a MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human GHR mRNA, designated herein as SEQ ID NO: 1 (GENBANK Accession No. NM_000163.4) or the human GHR genomic sequence, designated herein as SEQ ID NO: 2 (GENBANK Accession No. NT_006576.16 truncated from nucleotides 42411001 to 42714000). 'n/a' indicates that the antisense oligonucleotide does not target that particular gene sequence with 100% complementarity. In case the sequence alignment for a target gene in a particular table is not shown, it is understood that none of the oligonucleotides presented in that table align with 100% complementarity with that target gene.

TABLE 172

Inhibition of GHR mRNA by deoxy, MOE and (S)-cEt gapmers targeting intronic and exonic regions of SEQ ID NO: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541262 | n/a | Intron 2 | TTGGTTTGTCAATCCT | eekddddddddddkke | 84 | 156891 | 1370 |
| 541263 | 164 | Intron 1 | CCGAGCTTCGCCTCTG | eekddddddddddkke | 89 | 3040 | 1371 |
| 541264 | 167 | Intron 1 | CCTCCGAGCTTCGCCT | eekddddddddddkke | 90 | 3043 | 1372 |
| 541265 | 170 | Junction spanning two exons | GGACCTCCGAGCTTCG | eekddddddddddkke | 89 | n/a | 1373 |
| 541266 | 176 | Junction spanning two exons | CCTGTAGGACCTCCGA | eekddddddddddkke | 83 | n/a | 1374 |
| 541268 | 214 | Exon 2 | CCAGTGCCAAGGTCAA | eekddddddddddkke | 87 | 144998 | 1375 |
| 541269 | 226 | Exon 2 | CACTTGATCCTGCCAG | eekddddddddddkke | 67 | 145010 | 1376 |
| 541270 | 244 | Exon 2 | CACTTCCAGAAAAAGC | eekddddddddddkke | 34 | 145028 | 1377 |
| 541278 | 365 | Exon 4/Intron 3 | GTCTCTCGCTCAGGTG | eekddddddddddkke | 77 | 268028 | 1378 |
| 541279 | 368 | Exon 4/Intron 3 | AAAGTCTCTCGCTCAG | eekddddddddddkke | 76 | 268031 | 1379 |
| 541280 | 373 | Exon 4/Intron 3 | ATGAAAAAGTCTCTCG | eekddddddddddkke | 66 | 268036 | 1380 |
| 541283 | 445 | exon 2-exon 3 junction | TCCTTCTGGTATAGAA | eekddddddddddkke | 37 | n/a | 1381 |
| 541288 | 554 | Exon 5 | CAATAAGGTATCCAGA | eekddddddddddkke | 49 | 274114 | 1382 |
| 541289 | 561 | Exon 5 | CTTGATACAATAAGGT | eekddddddddddkke | 66 | 274121 | 1383 |
| 541290 | 569 | Exon 5 | CTAGTTAGCTTGATAC | eekddddddddddkke | 61 | 274129 | 1384 |
| 541293 | 628 | exon 3-exon 4 junction | GATCTGGTTGCACTAT | eekddddddddddkke | 57 | n/a | 1385 |
| 541294 | 639 | Exon 6 | GGCAATGGGTGGATCT | eekddddddddddkke | 38 | 278933 | 1386 |
| 541295 | 648 | Exon 6 | CCAGTTGAGGGCAATG | eekddddddddddkke | 67 | 278942 | 1387 |
| 541296 | 654 | Exon 6 | TAAAGTCCAGTTGAGG | eekddddddddddkke | 43 | 278948 | 1388 |
| 541301 | 924 | Exon 7 | TACATAGAGCACCTCA | eekddddddddddkke | 86 | 290422 | 1389 |
| 541302 | 927 | Exon 7 | TGTTACATAGAGCACC | eekddddddddddkke | 78 | 290425 | 1390 |
| 541303 | 930 | Exon 7 | AAGTGTTACATAGAGC | eekddddddddddkke | 59 | 290428 | 1391 |
| 541304 | 958 | Exon 7 | CTTCACATGTAAATTG | eekddddddddddkke | 26 | 290456 | 1392 |
| 541305 | 981 | Exon 8 | GAGCCATGGAAAGTAG | eekddddddddddkke | 66 | 292535 | 1393 |
| 541310 | 1127 | Exon 7-exon 8 junction | CCTTCCTTGAGGAGAT | eekddddddddddkke | 26 | n/a | 1394 |

TABLE 172-continued

Inhibition of GHR mRNA by deoxy, MOE and (S)-cEt gapmers targeting
intronic and exonic regions of SEQ ID NO: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541320 | 1317 | Exon 10 | CTTCACCCCTAGGTTA | eekddddddddddkke | 38 | 297734 | 1395 |
| 541321 | 1322 | Exon 10 | CCATCCTTCACCCCTA | eekddddddddddkke | 81 | 297739 | 1396 |
| 541322 | 1326 | Exon 10 | GTCGCCATCCTTCACC | eekddddddddddkke | 79 | 297743 | 1397 |
| 541323 | 1331 | Exon 10 | CCAGAGTCGCCATCCT | eekddddddddddkke | 64 | 297748 | 1398 |
| 541325 | 1420 | Exon 10 | GTGGCTGAGCAACCTC | eekddddddddddkke | 79 | 297837 | 1399 |
| 541326 | 1434 | Exon 10 | CCCTTTTAACCTCTGT | eekddddddddddkke | 67 | 297851 | 1400 |
| 541331 | 1492 | Exon 10 | CATCATGATAAGGTGA | eekddddddddddkke | 16 | 297909 | 1401 |
| 541332 | 1526 | Exon 10 | TGGATAACACTGGGCT | eekddddddddddkke | 30 | 297943 | 1402 |
| 541333 | 1532 | Exon 10 | TCTGCTTGGATAACAC | eekddddddddddkke | 63 | 297949 | 1403 |
| 541335 | 1597 | Exon 10 | GAATATGGGCAGCTTG | eekddddddddddkke | 33 | 298014 | 1404 |
| 541336 | 1601 | Exon 10 | AGCTGAATATGGGCAG | eekddddddddddkke | 34 | 298018 | 1405 |
| 541337 | 1607 | Exon 10 | TTGCTTAGCTGAATAT | eekddddddddddkke | 39 | 298024 | 1406 |
| 541338 | 1611 | Exon 10 | TGGATTGCTTAGCTGA | eekddddddddddkke | 79 | 298028 | 1407 |
| 541339 | 1614 | Exon 10 | ACTTGGATTGCTTAGC | eekddddddddddkke | 73 | 298031 | 1408 |

Example 120

Antisense Inhibition of Human Growth Hormone Receptor in Hep3B Cells by Deoxy, MOE and (S)-cEt Gapmers Additional antisense oligonucleotides were designed targeting a growth hormone receptor (GHR) nucleic acid and were tested for their effects on GHR mRNA in vitro. The antisense oligonucleotides were tested in a series of experiments that had similar culture conditions. The results for each experiment are presented in separate tables shown below. Cultured Hep3B cells at a density of 20,000 cells per well were transfected using electroporation with 4,500 nM antisense oligonucleotide. After a treatment period of approximately 24 hours, RNA was isolated from the cells and GHR mRNA levels were measured by quantitative real-time PCR. Human primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The newly designed chimeric antisense oligonucleotides in the Tables below were designed as deoxy, MOE, and (S)-cEt gapmers. The deoxy, MOE and (S)-cEt oligonucleotides are 16 nucleosides in length wherein the nucleoside have either a MOE sugar modification, an (S)-cEt sugar modification, or a deoxy modification. The 'Chemistry' column describes the sugar modifications of each oligonucleotide. 'k' indicates an (S)-cEt sugar modification; 'd' indicates deoxyribose; and 'e' indicates a MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human GHR mRNA, designated herein as SEQ ID NO: 1 (GENBANK Accession No. NM_000163.4) or the human GHR genomic sequence, designated herein as SEQ ID NO: 2 (GENBANK Accession No. NT_006576.16 truncated from nucleotides 42411001 to 42714000). 'n/a' indicates that the antisense oligonucleotide does not target that particular gene sequence with 100% complementarity. In case the sequence alignment for a target gene in a particular table is not shown, it is understood that none of the oligonucleotides presented in that table align with 100% complementarity with that target gene. The oligonucleotides of Table 175 do not target SEQ ID NOs: 1 or 2, but instead target variant gene sequences SEQ ID NO: 4 (GENBANK Accession No. DR006395.1) or SEQ ID NO: 7 (the complement of GENBANK Accession No. AA398260.1).

TABLE 173

Inhibition of GHR mRNA by deoxy, MOE and (S)-cEt gapmers targeting intronic and exonic regions of SEQ ID NO: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541262 | n/a | Intron 2 | TTGGTTTGTCAATCCT | eekddddddddddkke | 86 | 156891 | 1370 |
| 541340 | 1619 | Exon 10 | AGTGAACTTGGATTGC | eekddddddddddkke | 73 | 298036 | 1409 |
| 541341 | 1641 | Exon 10 | GGCATAAAAGTCGATG | eekddddddddddkke | 41 | 298058 | 1410 |
| 541342 | 1644 | Exon 10 | CTGGGCATAAAAGTCG | eekddddddddddkke | 33 | 298061 | 1411 |
| 541343 | 1683 | Exon 10 | GGAAAGGACCACACTA | eekddddddddddkke | 34 | 298100 | 1412 |
| 541344 | 1746 | Exon 10 | GAGTGAGACCATTTCC | eekddddddddddkke | 65 | 298163 | 1413 |
| 541345 | 1827 | Exon 10 | GATGTGAGGAGCCACA | eekddddddddddkke | 54 | 298244 | 1414 |
| 541346 | 1830 | Exon 10 | CTTGATGTGAGGAGCC | eekddddddddddkke | 70 | 298247 | 1415 |
| 541347 | 1835 | Exon 10 | TCAACCTTGATGTGAG | eekddddddddddkke | 38 | 298252 | 1416 |
| 541348 | 1839 | Exon 10 | TGATTCAACCTTGATG | eekddddddddddkke | 39 | 298256 | 1417 |
| 541349 | 1842 | Exon 10 | GTGTGATTCAACCTTG | eekddddddddddkke | 74 | 298259 | 1418 |
| 541350 | 1845 | Exon 10 | TATGTGTGATTCAACC | eekddddddddddkke | 58 | 298262 | 1419 |
| 541351 | 1949 | Exon 10 | GGCATCTCAGAACCTG | eekddddddddddkke | 41 | 298366 | 1420 |
| 541352 | 1965 | Exon 10 | GGTATAGTCTGGGACA | eekddddddddddkke | 18 | 298382 | 1421 |
| 541353 | 1969 | Exon 10 | TGGAGGTATAGTCTGG | eekddddddddddkke | 17 | 298386 | 1422 |
| 541354 | 1972 | Exon 10 | GAATGGAGGTATAGTC | eekddddddddddkke | 0 | 298389 | 1423 |
| 541355 | 1975 | Exon 10 | TATGAATGGAGGTATA | eekddddddddddkke | 0 | 298392 | 1424 |
| 541356 | 1978 | Exon 10 | CTATATGAATGGAGGT | eekddddddddddkke | 30 | 298395 | 1425 |
| 541357 | 1981 | Exon 10 | GTACTATATGAATGGA | eekddddddddddkke | 43 | 298398 | 1426 |
| 541358 | 1987 | Exon 10 | GGGACTGTACTATATG | eekddddddddddkke | 12 | 298404 | 1427 |
| 541369 | 2306 | Exon 10 | TTACATTGCACAATAG | eekddddddddddkke | 21 | 298723 | 1428 |
| 541373 | 2667 | Exon 10 | TAGCCATGCTTGAAGT | eekddddddddddkke | 34 | 299084 | 1429 |
| 541374 | 2686 | Exon 10 | TGTGTAGTGTAATATA | eekddddddddddkke | 10 | 299103 | 1430 |
| 541375 | 2690 | Exon 10 | ACAGTGTGTAGTGTAA | eekddddddddddkke | 82 | 299107 | 1431 |
| 541376 | 2697 | Exon 10 | GCAGTACACAGTGTGT | eekddddddddddkke | 46 | 299114 | 1432 |
| 541377 | 2700 | Exon 10 | ACTGCAGTACACAGTG | eekddddddddddkke | 32 | 299117 | 1433 |
| 541378 | 2740 | Exon 10 | TTAGACTGTAGTTGCT | eekddddddddddkke | 25 | 299157 | 1434 |
| 541379 | 2746 | Exon 10 | CCAGCTTTAGACTGTA | eekddddddddddkke | 69 | 299163 | 1435 |
| 541380 | 2750 | Exon 10 | TAAACCAGCTTTAGAC | eekddddddddddkke | 20 | 299167 | 1436 |
| 541381 | 2755 | Exon 10 | AACATTAAACCAGCTT | eekddddddddddkke | 64 | 299172 | 1437 |
| 541382 | 2849 | Exon 10 | ACTACAATCATTTTAG | eekddddddddddkke | 0 | 299266 | 1438 |
| 541383 | 2853 | Exon 10 | GATTACTACAATCATT | eekddddddddddkke | 0 | 299270 | 1439 |
| 541384 | 2859 | Exon 10 | AATGCAGATTACTACA | eekddddddddddkke | 46 | 299276 | 1440 |
| 541385 | 2865 | Exon 10 | TCCAATAATGCAGATT | eekddddddddddkke | 52 | 299282 | 1441 |
| 541386 | 2941 | Exon 10 | GTTGATCTGTGCAAAC | eekddddddddddkke | 74 | 299358 | 1442 |
| 541389 | 3037 | Exon 10 | TCTACTTCTCTTAGCA | eekddddddddddkke | 50 | 299454 | 1443 |

TABLE 173-continued

Inhibition of GHR mRNA by deoxy, MOE and (S)-cEt gapmers targeting intronic and exonic regions of SEQ ID NO: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541393 | 3215 | Exon 10 | GCTTCTTGTACCTTAT | eekddddddddddkke | 84 | 299632 | 1444 |
| 541394 | 3237 | Exon 10 | GATTTGCTTCAACTTA | eekddddddddddkke | 47 | 299654 | 1445 |
| 541395 | 3305 | Exon 10 | GGTTATAGGCTGTGAA | eekddddddddddkke | 0 | 299722 | 1446 |
| 541396 | 3308 | Exon 10 | TCTGGTTATAGGCTGT | eekddddddddddkke | 88 | 299725 | 1447 |
| 541397 | 3311 | Exon 10 | GTGTCTGGTTATAGGC | eekddddddddddkke | 56 | 299728 | 1448 |
| 541398 | 3316 | Exon 10 | AGTATGTGTCTGGTTA | eekddddddddddkke | 76 | 299733 | 1449 |
| 541399 | 3371 | Exon 10 | GGGACTGAAAACCTTG | eekddddddddddkke | 50 | 299788 | 1450 |
| 541400 | 3975 | Exon 10 | AGTATTCTTCACTGAG | eekddddddddddkke | 36 | 300392 | 1451 |
| 541401 | 4044 | Exon 10 | GCGATAAATGGGAAAT | eekddddddddddkke | 36 | 300461 | 1452 |
| 541402 | 4048 | Exon 10 | GTCTGCGATAAATGGG | eekddddddddddkke | 52 | 300465 | 1453 |
| 541403 | 4058 | Exon 10 | CCTAAAAAGGTCTGC | eekddddddddddkke | 51 | 300475 | 1454 |
| 541404 | 4072 | Exon 10 | CATTAAGCTTGCTTCC | eekddddddddddkke | 53 | 300489 | 1455 |

TABLE 174

Inhibition of GHR mRNA by deoxy, MOE and (S)-cEt gapmers targeting intronic and exonic regions of SEQ ID NO: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541262 | n/a | Intron 2 | TTGGTTTGTCAATCCT | eekddddddddddkke | 85 | 156891 | 1370 |
| 541421 | 4418 | Exon 10 | CACAACTAGTCATACT | eekddddddddddkke | 42 | 300835 | 1456 |
| 541422 | 4428 | Exon 10 | AACTGCCAGACACAAC | eekddddddddddkke | 68 | 300845 | 1457 |
| 541423 | 4431 | Exon 10 | ATAAACTGCCAGACAC | eekddddddddddkke | 86 | 300848 | 1458 |
| 541424 | 4503 | Exon 10 | TATCAGGAATCCAAGA | eekddddddddddkke | 11 | 300920 | 1459 |
| 541425 | 4521 | Exon 10 | TTGATAACAGAAGCAC | eekddddddddddkke | 16 | 300938 | 1460 |
| 541426 | 4528 | Exon 10 | TTGGTGTTTGATAACA | eekddddddddddkke | 31 | 300945 | 1461 |
| 541427 | 4531 | Exon 10 | ATGTTGGTGTTTGATA | eekddddddddddkke | 32 | 300948 | 1462 |
| 541429 | 30 | Exon 1 | CCGCCACTGTAGCAGC | eekddddddddddkke | 77 | 2906 | 1463 |
| 541430 | 35 | Exon 1 | CGCCACCGCCACTGTA | eekddddddddddkke | 88 | 2911 | 1464 |
| 541431 | 63 | Exon 1 | GCCGCCCGGGCTCAGC | eekddddddddddkke | 86 | 2939 | 1465 |
| 541432 | 67 | Exon 1 | CGCCGCCGCCCGGGCT | eekddddddddddkke | 61 | 2943 | 1466 |
| 541433 | 144 | Exon 1 | GAGAGCGCGGGTTCGC | eekddddddddddkke | 57 | 3020 | 1467 |
| 541434 | n/a | Exon 1/Intron 1 | CTACTGACCCCAGTTC | eekddddddddddkke | 80 | 3655 | 1468 |
| 541435 | n/a | Exon 1/Intron 1 | TCACTCTACTGACCCC | eekddddddddddkke | 90 | 3660 | 1469 |
| 541436 | n/a | Exon 1/Intron 1 | TCATGCGGACTGGTGG | eekddddddddddkke | 56 | 3679 | 1470 |

TABLE 174-continued

Inhibition of GHR mRNA by deoxy, MOE and (S)-cEt gapmers
targeting intronic and exonic regions of SEQ ID NO: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541437 | n/a | Exon 3/Intron 3 | ATGTGAGCATGGACCC | eekddddddddddkke | 82 | 225438 | 1471 |
| 541438 | n/a | Exon 3/Intron 3 | TCTTGATATGTGAGCA | eekddddddddddkke | 93 | 225445 | 1472 |
| 541439 | n/a | Exon 3/Intron 3 | TTCAAGTTGGTGAGCT | eekddddddddddkke | 72 | 226788 | 1473 |
| 541440 | n/a | Exon 3/Intron 3 | TGCTTCCTTCAAGTTG | eekddddddddddkke | 68 | 226795 | 1474 |
| 541441 | n/a | Exon 3/Intron 3 | TGTAATTTCATTCATG | eekddddddddddkke | 62 | 226809 | 1475 |
| 541442 | n/a | Exon 3/Intron 3 | CCTTTTGCCAAGAGCA | eekddddddddddkke | 85 | 226876 | 1476 |
| 541443 | n/a | Exon 3/Intron 3 | GATCCTTTTGCCAAGA | eekddddddddddkke | 77 | 226879 | 1477 |
| 541444 | n/a | Exon 3/Intron 3 | GCTAGTAATGTTACAT | eekddddddddddkke | 68 | 238331 | 1478 |
| 541445 | n/a | Exon 3/Intron 3 | GCAACTTGCTAGTAAT | eekddddddddddkke | 65 | 238338 | 1479 |
| 541446 | n/a | Exon 3/Intron 3 | TGTGCAACTTGCTAGT | eekddddddddddkke | 44 | 238341 | 1480 |
| 541447 | n/a | Exon 3/Intron 3 | GGATTTCAGTTTGAAT | eekddddddddddkke | 0 | 238363 | 1481 |
| 541448 | n/a | Exon 3/Intron 3 | CTCAGAGCCTTGGTAG | eekddddddddddkke | 65 | 238428 | 1482 |
| 541449 | n/a | Exon 1/Intron 1 | CAAACGCGCAAAAGAC | eekddddddddddkke | 1 | 3608 | 1483 |
| 541450 | n/a | Exon 1/Intron 1 | GCCCGCACAAACGCGC | eekddddddddddkke | 11 | 3615 | 1484 |
| 541451 | n/a | Exon 1/Intron 1 | GGTTAAAGAAGTTGCT | eekddddddddddkke | 60 | 93190 | 1485 |
| 541452 | n/a | Exon 1/Intron 1 | CCCAGTGAATTCAGCA | eekddddddddddkke | 85 | 93245 | 1486 |
| 541453 | n/a | Exon 1/Intron 1 | GCGCCCAGTGAATTCA | eekddddddddddkke | 74 | 93248 | 1487 |
| 541454 | n/a | Exon 1/Intron 1 | AAGATGCGCCCAGTGA | eekddddddddddkke | 71 | 93253 | 1488 |
| 541455 | n/a | Exon 1/Intron 1 | TGTAAGATGCGCCCAG | eekddddddddddkke | 75 | 93256 | 1489 |
| 541456 | n/a | Exon 1/Intron 1 | AATTACTTGTAAGATG | eekddddddddddkke | 15 | 93263 | 1490 |
| 541457 | n/a | Exon 1/Intron 1 | CCCAGAAGGCACTTGT | eekddddddddddkke | 61 | 93302 | 1491 |
| 541458 | n/a | Exon 1/Intron 1 | TTGCAGAACAAATCTT | eekddddddddddkke | 3 | 93333 | 1492 |
| 541459 | n/a | Exon 1/Intron 1 | CATGGAAGATTTGCAG | eekddddddddddkke | 17 | 93343 | 1493 |
| 541460 | n/a | Exon 1/Intron 1 | GGTCATGGAAGATTTG | eekddddddddddkke | 57 | 93346 | 1494 |
| 541461 | n/a | Exon 1/Intron 1 | GACCTTGGTCATGGAA | eekddddddddddkke | 51 | 93352 | 1495 |
| 541462 | n/a | Exon 1/Intron 1 | TGCCAATCCAAAGAGG | eekddddddddddkke | 34 | 93369 | 1496 |
| 541463 | n/a | Exon 1/Intron 1 | GGGTCTGCCAATCCAA | eekddddddddddkke | 67 | 93374 | 1497 |
| 541464 | n/a | Exon 1/Intron 1 | TCCCTGGGTCTGCCAA | eekddddddddddkke | 82 | 93379 | 1498 |
| 541465 | n/a | Exon 1/Intron 1 | AAGTGTGAATTTATCT | eekddddddddddkke | 16 | 93408 | 1499 |
| 541466 | n/a | Exon 1/Intron 1 | GGAGATCTCAACAAGG | eekddddddddddkke | 38 | 93428 | 1500 |
| 541468 | n/a | Exon 1/Intron 1 | TCGCCCATCACTCTTC | eekddddddddddkke | 43 | 93989 | 1501 |
| 541469 | n/a | Exon 1/Intron 1 | CCTGTCGCCCATCACT | eekddddddddddkke | 61 | 93993 | 1502 |
| 541470 | n/a | Exon 1/Intron 1 | TCACCTGTCGCCCATC | eekddddddddddkke | 70 | 93996 | 1503 |

TABLE 174-continued

Inhibition of GHR mRNA by deoxy, MOE and (S)-cEt gapmers targeting intronic and exonic regions of SEQ ID NO: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541471 | n/a | Exon 1/Intron 1 | CCATCACCTGTCGCCC | eekddddddddddkke | 89 | 93999 | 1504 |
| 541472 | n/a | Exon 1/Intron 1 | TCACCATCACCTGTCG | eekddddddddddkke | 72 | 94002 | 1505 |
| 541473 | n/a | Exon 1/Intron 1 | TAATAGTTGTCACCAT | eekddddddddddkke | 42 | 94011 | 1506 |
| 541474 | n/a | Exon 1/Intron 1 | TTCAGATCTTATTAAT | eekddddddddddkke | 0 | 94023 | 1507 |
| 541475 | n/a | Exon 1/Intron 1 | TTGCAAATTCAGTCTG | eekddddddddddkke | 32 | 94096 | 1508 |
| 541477 | n/a | Exon 2/Intron 2 | CGTTCTCTTGGAAGTA | eekddddddddddkke | 78 | 198766 | 1509 |
| 541478 | n/a | Exon 2/Intron 2 | TCTTGAATAAATTTCG | eekddddddddddkke | 25 | 198780 | 1510 |
| 541479 | n/a | Exon 2/Intron 2 | AAGCTCACTCTTCAAT | eekddddddddddkke | 60 | 198810 | 1511 |
| 541480 | n/a | Exon 2/Intron 2 | TCCAAGCTCACTCTTC | eekddddddddddkke | 49 | 198813 | 1512 |
| 541481 | n/a | Exon 2/Intron 2 | GCTCCTGCCACTCTGT | eekddddddddddkke | 75 | 198837 | 1513 |
| 541482 | n/a | Exon 2/Intron 2 | ATGGGCAAAGGCATCT | eekddddddddddkke | 60 | 198874 | 1514 |
| 541483 | n/a | 5' UTR | AGTCTTCCCGGCGAGG | eekddddddddddkke | 32 | 2571 | 1515 |
| 541484 | n/a | 5' and overlappig with exon 1 | CCGCCGCTCCCTAGCC | eekddddddddddkke | 73 | 2867 | 1516 |
| 541485 | n/a | Intron 1 | GCCCGCAACTCCCTGC | eekddddddddddkke | 37 | 3341 | 1517 |
| 541486 | n/a | Intron 1 | CGCCTCCCCAGGCGCA | eekddddddddddkke | 34 | 4024 | 1518 |
| 541487 | n/a | Intron 1 | GAGTGTCTTCCCAGGC | eekddddddddddkke | 86 | 4446 | 1519 |
| 541488 | n/a | Intron 1 | CTGAAGACTCCTTGAA | eekddddddddddkke | 39 | 4721 | 1520 |
| 541489 | n/a | Intron 1 | GGCTAGCCAAGTTGGA | eekddddddddddkke | 54 | 5392 | 1521 |
| 541490 | n/a | Intron 1 | TGACTCCAGTCTTACC | eekddddddddddkke | 76 | 5802 | 1522 |
| 541491 | n/a | Intron 1 | ATTCATTGTGGTCAGC | eekddddddddddkke | 91 | 6128 | 1523 |
| 541492 | n/a | Intron 1 | GAAGTGGGTTTTTCCC | eekddddddddddkke | 86 | 6543 | 1524 |
| 541493 | n/a | Intron 1 | GCCTTGGTTCAGGTGA | eekddddddddddkke | 79 | 6786 | 1525 |

TABLE 175

Inhibition of GHR mRNA by deoxy, MOE and (S)-cEt gapmers targeting SEQ ID NO: 4 and 7

| ISIS NO | Target Start Site | Target SEQ ID NO | Sequence | Chemistry | % inhibition | SEQ ID NO |
|---|---|---|---|---|---|---|
| 541428 | 66 | 4 | CCACTGTAGCAGCCGC | eekdddddddddddkke | 92 | 1526 |
| 541476 | 263 | 7 | TAGGTATTTCAGAGCC | eekdddddddddddkke | 80 | 1527 |

TABLE 176

Inhibition of GHR mRNA by deoxy, MOE and (S)-cEt gapmers targeting intronic regions of SEQ ID NO: 2

| ISIS NO | SEQ ID NO: 1 Start Site | SEQ ID NO: 2 Start Site | Target Region | Sequence | Chemistry | % inhibition | SEQ ID NO |
|---|---|---|---|---|---|---|---|
| 541262 | 156891 | 541277 | Intron 2 | TTGGTTTGTCAATCCT | eekddddddddddkke | 80 | 1370 |
| 541494 | 7231 | 541509 | Intron 1 | GTCCAGGCAGAGTTGT | eekddddddddddkke | 30 | 1528 |
| 541495 | 7570 | 541510 | Intron 1 | AGCCAAATGTTGGTCA | eekddddddddddkke | 19 | 1529 |
| 541496 | 8395 | 541511 | Intron 1 | GAGGGCGAGTTTTTCC | eekddddddddddkke | 71 | 1530 |
| 541497 | 9153 | 541512 | Intron 1 | GTGGCATTGGCAAGCC | eekddddddddddkke | 81 | 1531 |
| 541498 | 9554 | 541513 | Intron 1 | ACCCCACTGCACCAAG | eekddddddddddkke | 67 | 1532 |
| 541499 | 9931 | 541514 | Intron 1 | TCCAAGTACTTGCCAA | eekddddddddddkke | 83 | 1533 |
| 541500 | 10549 | 541515 | Intron 1 | AGTGCCTGGCCTAAGG | eekddddddddddkke | 75 | 1534 |
| 541501 | 11020 | 541516 | Intron 1 | GCGCTTCTTCCCTAGG | eekddddddddddkke | 71 | 1535 |
| 541502 | 11793 | 541517 | Intron 1 | CATCTTGCCCAGGGAT | eekddddddddddkke | 84 | 1536 |
| 541503 | 12214 | 541518 | Intron 1 | CCATCTTGCTCCAAGT | eekddddddddddkke | 93 | 1537 |
| 541504 | 12474 | 541519 | Intron 1 | CTTACATCCTGTAGGC | eekddddddddddkke | 71 | 1538 |
| 541505 | 12905 | 541520 | Intron 1 | CGCCTCCTGGTCCTCA | eekddddddddddkke | 97 | 1539 |
| 541506 | 13400 | 541521 | Intron 1 | CCCTATGCACTACCTA | eekddddddddddkke | 49 | 1540 |
| 541507 | 13717 | 541522 | Intron 1 | GAGGGACTGTGGTGCT | eekddddddddddkke | 65 | 1541 |
| 541508 | 14149 | 541523 | Intron 1 | GCCCAATATGTGCCAG | eekddddddddddkke | 60 | 1542 |
| 541509 | 14540 | 541524 | Intron 1 | GCTCTCTCATCGCTGG | eekddddddddddkke | 90 | 1543 |
| 541510 | 15264 | 541525 | Intron 1 | CTCAAGGCTATGTGCC | eekddddddddddkke | 67 | 1544 |
| 541511 | 15849 | 541526 | Intron 1 | TCCACATCCCTCATGT | eekddddddddddkke | 68 | 1545 |
| 541512 | 16530 | 541527 | Intron 1 | AGGACTGAAGGCCCAT | eekddddddddddkke | 49 | 1546 |
| 541513 | 17377 | 541528 | Intron 1 | GTGCGACTTACCAGCT | eekddddddddddkke | 85 | 1547 |
| 541514 | 17581 | 541529 | Intron 1 | TCGCTAAAGCCACACA | eekddddddddddkke | 89 | 1548 |
| 541515 | 17943 | 541530 | Intron 1 | GCTCTGGCTGATGGTC | eekddddddddddkke | 92 | 1549 |
| 541516 | 18353 | 541531 | Intron 1 | TTCCCATGAGGATTTC | eekddddddddddkke | 70 | 1550 |
| 541517 | 18636 | 541532 | Intron 1 | TTGGGCTTAAGCACTA | eekddddddddddkke | 71 | 1551 |
| 541518 | 19256 | 541533 | Intron 1 | GCTAGCACCTAGTCCA | eekddddddddddkke | 71 | 1552 |
| 541519 | 19814 | 541534 | Intron 1 | CCTCTGGCCTACAACA | eekddddddddddkke | 64 | 1553 |
| 541520 | 20365 | 541535 | Intron 1 | ACCCCTCATCAGCACC | eekddddddddddkke | 93 | 1554 |
| 541521 | 20979 | 541536 | Intron 1 | GGCCACCCCTGATCCT | eekddddddddddkke | 66 | 1555 |
| 541522 | 21566 | 541537 | Intron 1 | GAAGCTCCCTTGCCCA | eekddddddddddkke | 96 | 1556 |
| 541523 | 22150 | 541538 | Intron 1 | AGTGTTGCCCCTCCAA | eekddddddddddkke | 83 | 1557 |
| 541524 | 22803 | 541539 | Intron 1 | GGGTCTCCAACCTACT | eekddddddddddkke | 70 | 1558 |
| 541525 | 29049 | 541540 | Intron 1 | GGGATGTAGGTTTACC | eekddddddddddkke | 74 | 1559 |
| 541526 | 29554 | 541541 | Intron 1 | GCAACCGATATCACAG | eekddddddddddkke | 60 | 1560 |
| 541527 | 30245 | 541542 | Intron 1 | TGCCCTGGAACAAATT | eekddddddddddkke | 13 | 1561 |
| 541528 | 30550 | 541543 | Intron 1 | AGTCTAGGAGTAGCTA | eekddddddddddkke | 50 | 1562 |

TABLE 176-continued

Inhibition of GHR mRNA by deoxy, MOE and (S)-cEt gapmers targeting intronic regions of SEQ ID NO: 2

| ISIS NO | SEQ ID NO: 1 Start Site | SEQ ID NO: 2 Start Site | Target Region | Sequence | Chemistry | % inhibition | SEQ ID NO |
|---|---|---|---|---|---|---|---|
| 541529 | 30915 | 541544 | Intron 1 | GCTGTTGTCAAGAGAC | eekddddddddddkke | 55 | 1563 |
| 541530 | 31468 | 541545 | Intron 1 | CACCTAGACACTCAGT | eekddddddddddkke | 47 | 1564 |
| 541531 | 32366 | 541546 | Intron 1 | GTCAAGGGATCCCTGC | eekddddddddddkke | 34 | 1565 |
| 541532 | 32897 | 541547 | Intron 1 | TCCCCCTGGCACTCCA | eekddddddddddkke | 79 | 1566 |
| 541533 | 33187 | 541548 | Intron 1 | GCCTGGTAACTCCATT | eekddddddddddkke | 56 | 1567 |
| 541534 | 33780 | 541549 | Intron 1 | GGGCTCACCAACTGTG | eekddddddddddkke | 39 | 1568 |
| 541535 | 34407 | 541550 | Intron 1 | CCACAGGATCATATCA | eekddddddddddkke | 37 | 1569 |
| 541536 | 34846 | 541551 | Intron 1 | CTCCAGCAGAAGTGTC | eekddddddddddkke | 10 | 1570 |
| 541537 | 35669 | 541552 | Intron 1 | AGCCCAACTGTTGCCT | eekddddddddddkke | 79 | 1571 |
| 541538 | 36312 | 541553 | Intron 1 | TGCCAGGCAGTTGCCA | eekddddddddddkke | 75 | 1572 |
| 541539 | 36812 | 541554 | Intron 1 | GCCAGTAAGCACCTTG | eekddddddddddkke | 93 | 1573 |
| 541540 | 37504 | 541555 | Intron 1 | CTAGCTTCCCAGCCCC | eekddddddddddkke | 46 | 1574 |
| 541541 | 38841 | 541556 | Intron 1 | TCAAGCCCAGCTAGCA | eekddddddddddkke | 39 | 1575 |
| 541542 | 39108 | 541557 | Intron 1 | CCTCACAGGCCCTAAT | eekddddddddddkke | 4 | 1576 |
| 541543 | 39408 | 541558 | Intron 1 | ACCTGCTTACATGGTA | eekddddddddddkke | 21 | 1577 |
| 541544 | 40250 | 541559 | Intron 1 | CCTTTGCTAGGACCCA | eekddddddddddkke | 52 | 1578 |
| 541545 | 40706 | 541560 | Intron 1 | GGGACTGCCACCAAGG | eekddddddddddkke | 27 | 1579 |
| 541546 | 40922 | 541561 | Intron 1 | GCTAGATGTTCAGGCC | eekddddddddddkke | 34 | 1580 |
| 541547 | 41424 | 541562 | Intron 1 | CCTATGGCCATGCTGA | eekddddddddddkke | 32 | 1581 |
| 541548 | 41999 | 541563 | Intron 1 | GTATGCTAGTTCCCAT | eekddddddddddkke | 83 | 1582 |
| 541549 | 42481 | 541564 | Intron 1 | CCCTCATAATCTTGGG | eekddddddddddkke | 13 | 1583 |
| 541550 | 42700 | 541565 | Intron 1 | GTCCAACCACTACCAC | eekddddddddddkke | 74 | 1584 |
| 541551 | 43291 | 541566 | Intron 1 | ACTTGCAGATAGCTGA | eekddddddddddkke | 73 | 1585 |
| 541552 | 43500 | 541567 | Intron 1 | GCATGACCCCACTGCC | eekddddddddddkke | 72 | 1586 |
| 541553 | 43947 | 541568 | Intron 1 | GAGGGTCACATTCCCT | eekddddddddddkke | 23 | 1587 |
| 541554 | 44448 | 541569 | Intron 1 | TCTCTTACTGGTGGGT | eekddddddddddkke | 90 | 1588 |
| 541555 | 45162 | 541570 | Intron 1 | GCCCCCTTCCTGGATA | eekddddddddddkke | 28 | 1589 |
| 541556 | 46010 | 541571 | Intron 1 | CCTCATGCGACACCAC | eekddddddddddkke | 71 | 1590 |
| 541557 | 46476 | 541572 | Intron 1 | AGCCCTCTGCCTGTAA | eekddddddddddkke | 67 | 1591 |
| 541558 | 47447 | 541573 | Intron 1 | CTCCCAGCTATAGGCG | eekddddddddddkke | 38 | 1592 |
| 541559 | 47752 | 541574 | Intron 1 | GCTAGCTGCGCAAGGA | eekddddddddddkke | 5 | 1593 |
| 541560 | 48001 | 541575 | Intron 1 | GCGCAGCCCGCTGCAA | eekddddddddddkke | 18 | 1594 |
| 541561 | 48423 | 541576 | Intron 1 | TGCATGATCCACCCCA | eekddddddddddkke | 65 | 1595 |
| 541562 | 50195 | 541577 | Intron 1 | GCTTAGTGCTGGCCCA | eekddddddddddkke | 72 | 1596 |
| 541563 | 50470 | 541578 | Intron 1 | CCTTCCAGTCCTCATA | eekddddddddddkke | 81 | 1597 |

TABLE 176-continued

Inhibition of GHR mRNA by deoxy, MOE and (S)-cEt gapmers targeting intronic regions of SEQ ID NO: 2

| ISIS NO | SEQ ID NO: 1 Start Site | SEQ ID NO: 2 Start Site | Target Region | Sequence | Chemistry | % inhibition | SEQ ID NO |
|---|---|---|---|---|---|---|---|
| 541564 | 51104 | 541579 | Intron 1 | ATAGTGTCAAGGCCCA | eekddddddddddkke | 91 | 1598 |
| 541565 | 51756 | 541580 | Intron 1 | AGGCCTTAGTCACCCA | eekddddddddddkke | 88 | 1599 |
| 541566 | 52015 | 541581 | Intron 1 | TAACCAACCTAAGGGA | eekddddddddddkke | 11 | 1600 |
| 541567 | 52230 | 541582 | Intron 1 | ATTCTGGTGATGCCCT | eekddddddddddkke | 66 | 1601 |
| 541568 | 52588 | 541583 | Intron 1 | GTGTTCACTGCCATGA | eekddddddddddkke | 67 | 1602 |
| 541569 | 53532 | 541584 | Intron 1 | GGTAGAGCACACTGCC | eekddddddddddkke | 47 | 1603 |
| 541570 | 54645 | 541585 | Intron 1 | CCACTTTAATGCCACC | eekddddddddddkke | 76 | 1604 |

TABLE 177

Inhibition of GHR mRNA by deoxy, MOE and (S)-cEt gapmers targeting intronic regions of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541262 | 156891 | 156906 | Intron 2 | TTGGTTTGTCAATCCT | eekddddddddddkke | 88 | 1370 |
| 541571 | 54886 | 54901 | Intron 1 | GTCAAATGCTGTTGGG | eekddddddddddkke | 91 | 1605 |
| 541572 | 55900 | 55915 | Intron 1 | CATCCCCTATCAGGGT | eekddddddddddkke | 53 | 1606 |
| 541573 | 62266 | 62281 | Intron 1 | CTCGAATCCCTTGAGC | eekddddddddddkke | 73 | 1607 |
| 541574 | 62733 | 62748 | Intron 1 | GATTCCCTCCCCTAAC | eekddddddddddkke | 27 | 1608 |
| 541575 | 63173 | 63188 | Intron 1 | ATCCATCCATGTGCTG | eekddddddddddkke | 92 | 1609 |
| 541576 | 63751 | 63766 | Intron 1 | GAGCATGCCTCAGTGG | eekddddddddddkke | 81 | 1610 |
| 541577 | 63964 | 63979 | Intron 1 | CAGAAGGACTGCCTCT | eekddddddddddkke | 50 | 1611 |
| 541578 | 64213 | 64228 | Intron 1 | ACAATGCTCAACAGCC | eekddddddddddkke | 75 | 1612 |
| 541579 | 64576 | 64591 | Intron 1 | GTTGGATCTGGCATGC | eekddddddddddkke | 80 | 1613 |
| 541580 | 65027 | 65042 | Intron 1 | CGGCTGAGAGCAAGGG | eekddddddddddkke | 88 | 1614 |
| 541581 | 65363 | 65378 | Intron 1 | GAGAGGGTTCAGCCTG | eekddddddddddkke | 62 | 1615 |
| 541582 | 65600 | 65615 | Intron 1 | ACTTAGTTCCTAGCCA | eekddddddddddkke | 91 | 1616 |
| 541583 | 66087 | 66102 | Intron 1 | GTGAACCAGATGTGCT | eekddddddddddkke | 86 | 1617 |
| 541584 | 66566 | 66581 | Intron 1 | GGAGTGACAGCTAAGT | eekddddddddddkke | 98 | 1618 |
| 541585 | 66978 | 66993 | Intron 1 | AAGTGTTCAGAGCCAC | eekddddddddddkke | 97 | 1619 |
| 541586 | 67662 | 67677 | Intron 1 | AACCCTGCCAAGGTAC | eekddddddddddkke | 45 | 1620 |
| 541587 | 67914 | 67929 | Intron 1 | GATGGTGAGCACTACC | eekddddddddddkke | 78 | 1621 |
| 541588 | 68278 | 68293 | Intron 1 | GGCAGGATAGGACAGA | eekddddddddddkke | 11 | 1622 |
| 541589 | 68727 | 68742 | Intron 1 | GCAAAGTGATGAGCCT | eekddddddddddkke | 81 | 1623 |
| 541590 | 69207 | 69222 | Intron 1 | CTATCCACACCATTCC | eekddddddddddkke | 93 | 1624 |
| 541591 | 69605 | 69620 | Intron 1 | GGATCATGGGCCCCTA | eekddddddddddkke | 70 | 1625 |

TABLE 177-continued

Inhibition of GHR mRNA by deoxy, MOE and (S)-cEt gapmers targeting intronic regions of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541592 | 70130 | 70145 | Intron 1 | GTGAATTTGCTGGGCC | eekddddddddddkke | 94 | 1626 |
| 541593 | 70569 | 70584 | Intron 1 | GTGATGGGCCCAAGGC | eekddddddddddkke | 67 | 1627 |
| 541594 | 71056 | 71071 | Intron 1 | TCCTCAGTCGGCTTGC | eekddddddddddkke | 69 | 1628 |
| 541595 | 71314 | 71329 | Intron 1 | CAGCCTTTTGCCAGAT | eekddddddddddkke | 93 | 1629 |
| 541596 | 71620 | 71635 | Intron 1 | CCTCCCTAGGATTACC | eekddddddddddkke | 42 | 1630 |
| 541597 | 72226 | 72241 | Intron 1 | ACGCCCCAATCACTCA | eekddddddddddkke | 79 | 1631 |
| 541598 | 72655 | 72670 | Intron 1 | GCATGACCCATTATGT | eekddddddddddkke | 94 | 1632 |
| 541599 | 73061 | 73076 | Intron 1 | TCCCTCCAAGAGCTCA | eekddddddddddkke | 83 | 1633 |
| 541600 | 73708 | 73723 | Intron 1 | GATGCCTGTGGCTGAC | eekddddddddddkke | 84 | 1634 |
| 541601 | 74107 | 74122 | Intron 1 | GGCTAGCATGTTGCCT | eekddddddddddkke | 19 | 1635 |
| 541602 | 74542 | 74557 | Intron 1 | TAACCCACTAGGCTGG | eekddddddddddkke | 84 | 1636 |
| 541603 | 74947 | 74962 | Intron 1 | TGGCCCAAAACTAATC | eekddddddddddkke | 34 | 1637 |
| 541604 | 75192 | 75207 | Intron 1 | GGAGCAGTCTGGCACC | eekddddddddddkke | 85 | 1638 |
| 541605 | 75699 | 75714 | Intron 1 | TATTCTGTGGGACAAG | eekddddddddddkke | 51 | 1639 |
| 541606 | 75979 | 75994 | Intron 1 | GTGTCTAGTTCCAGCC | eekddddddddddkke | 86 | 1640 |
| 541607 | 76410 | 76425 | Intron 1 | TACTATCATGTAGCGC | eekddddddddddkke | 87 | 1641 |
| 541608 | 76701 | 76716 | Intron 1 | TGCCCTTGTAGTGAGA | eekddddddddddkke | 31 | 1642 |
| 541609 | 76980 | 76995 | Intron 1 | TCCCCAACCTACAAGC | eekddddddddddkke | 41 | 1643 |
| 541610 | 77292 | 77307 | Intron 1 | GCTCTAGGCATATGAA | eekddddddddddkke | 63 | 1644 |
| 541611 | 77555 | 77570 | Intron 1 | TACCTCCCTTGTAGGG | eekddddddddddkke | 27 | 1645 |
| 541612 | 77854 | 77869 | Intron 1 | GGTTCCCTTGCAGAGA | eekddddddddddkke | 62 | 1646 |
| 541613 | 78311 | 78326 | Intron 1 | GTGCCCTCTTCATGCC | eekddddddddddkke | 68 | 1647 |
| 541614 | 79006 | 79021 | Intron 1 | CCTGTGTGCAACTGGC | eekddddddddddkke | 85 | 1648 |
| 541615 | 79490 | 79505 | Intron 1 | CTGAGTCATTTGCCTG | eekddddddddddkke | 93 | 1649 |
| 541616 | 79829 | 79844 | Intron 1 | GGCCTTAGTAGGCCAG | eekddddddddddkke | 0 | 1650 |
| 541617 | 80277 | 80292 | Intron 1 | GTCCTTGCAGTCAACC | eekddddddddddkke | 77 | 1651 |
| 541618 | 80575 | 80590 | Intron 1 | GCTGGGCCAAGTCCAT | eekddddddddddkke | 77 | 1652 |
| 541619 | 80895 | 80910 | Intron 1 | TAGGGCACTTTTTGCC | eekddddddddddkke | 31 | 1653 |
| 541620 | 81207 | 81222 | Intron 1 | GCTGAGGTCCCTCTCT | eekddddddddddkke | 34 | 1654 |
| 541621 | 81761 | 81776 | Intron 1 | CTTTGGTCCCATTGCC | eekddddddddddkke | 83 | 1655 |
| 541622 | 82233 | 82248 | Intron 1 | GGAACATGCCAAGGGC | eekddddddddddkke | 91 | 1656 |
| 541623 | 82738 | 82753 | Intron 1 | AGGTGGTCTCCCTTCA | eekddddddddddkke | 74 | 1657 |
| 541624 | 83056 | 83071 | Intron 1 | TCCCAAAGCTCCCCTC | eekddddddddddkke | 53 | 1658 |
| 541625 | 83401 | 83416 | Intron 1 | CCTGGCCTAGCAAGCT | eekddddddddddkke | 47 | 1659 |
| 541626 | 84048 | 84063 | Intron 1 | TCTTAGCCCTGGGCTA | eekddddddddddkke | 12 | 1660 |

TABLE 177-continued

Inhibition of GHR mRNA by deoxy, MOE and (S)-cEt gapmers targeting intronic regions of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541627 | 84388 | 84403 | Intron 1 | GACTTGGACTGGGCTC | eekddddddddddkke | 81 | 1661 |
| 541628 | 85261 | 85276 | Intron 1 | GGCCTAGGATCTAGGA | eekddddddddddkke | 0 | 1662 |
| 541629 | 85714 | 85729 | Intron 1 | GTCAGGCTAGAGGGAC | eekddddddddddkke | 41 | 1663 |
| 541630 | 86220 | 86235 | Intron 1 | GGAAGTTCTCCCAGCC | eekddddddddddkke | 47 | 1664 |
| 541631 | 86640 | 86655 | Intron 1 | CCTGACTGATGTACAC | eekddddddddddkke | 35 | 1665 |
| 541632 | 86903 | 86918 | Intron 1 | CTCTGGCCTAGCCTAT | eekddddddddddkke | 54 | 1666 |
| 541633 | 87247 | 87262 | Intron 1 | GGCTGCTGTCAGATGC | eekddddddddddkke | 79 | 1667 |
| 541634 | 88293 | 88308 | Intron 1 | TCTCAGGTGTAGGCAG | eekddddddddddkke | 59 | 1668 |
| 541635 | 88605 | 88620 | Intron 1 | GGTCACTGAGACTGGG | eekddddddddddkke | 88 | 1669 |
| 541636 | 88952 | 88967 | Intron 1 | ACCCACTAGCAGCTAG | eekddddddddddkke | 61 | 1670 |
| 541637 | 89160 | 89175 | Intron 1 | CGGATGAGGCAGTTAG | eekddddddddddkke | 42 | 1671 |
| 541638 | 89855 | 89870 | Intron 1 | TGGTAGGCCCTCTGGC | eekddddddddddkke | 28 | 1672 |
| 541639 | 90240 | 90255 | Intron 1 | GTCACAAGGTGGGTGC | eekddddddddddkke | 28 | 1673 |
| 541640 | 90513 | 90528 | Intron 1 | GTCTTGCCCTCACGGA | eekddddddddddkke | 73 | 1674 |
| 541641 | 91073 | 91088 | Intron 1 | GCAGTCTGTGGACTTA | eekddddddddddkke | 93 | 1675 |
| 541642 | 91647 | 91662 | Intron 1 | TGCTCTCTGGTCACAC | eekddddddddddkke | 75 | 1676 |
| 541643 | 92069 | 92084 | Intron 1 | TATCCCCCAGAGCCAT | eekddddddddddkke | 68 | 1677 |
| 541644 | 92356 | 92371 | Intron 1 | AAGGTGAGAGGGCACT | eekddddddddddkke | 75 | 1678 |
| 541645 | 92904 | 92919 | Intron 1 | GTTTTAACCTCACCCT | eekddddddddddkke | 0 | 1679 |
| 541646 | 93846 | 93861 | Intron 1 | CCTTCCACTGACCTTC | eekddddddddddkke | 56 | 1680 |
| 541647 | 94374 | 94389 | Intron 1 | GACACTAGCCTAAGCC | eekddddddddddkke | 37 | 1681 |

TABLE 178

Inhibition of GHR mRNA by deoxy, MOE and (S)-cEt gapmers targeting intronic regions of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541262 | 156891 | 156906 | Intron 2 | TTGGTTTGTCAATCCT | eekddddddddddkke | 94 | 1370 |
| 541648 | 94638 | 94653 | Intron 1 | GGTTAGCCCTCAGCCT | eekddddddddddkke | 61 | 1682 |
| 541649 | 94839 | 94854 | Intron 1 | TATGAAGGTTGGACCA | eekddddddddddkke | 69 | 1683 |
| 541650 | 95509 | 95524 | Intron 1 | CAACCAGCTCACCTGA | eekddddddddddkke | 37 | 1684 |
| 541651 | 95829 | 95844 | Intron 1 | GGGCTCCAAGGCTCTC | eekddddddddddkke | 75 | 1685 |
| 541652 | 96158 | 96173 | Intron 1 | AGCTGTTACATGCCAA | eekddddddddddkke | 93 | 1686 |
| 541653 | 96488 | 96503 | Intron 1 | GGCCCAGAGGTTATAG | eekddddddddddkke | 30 | 1687 |
| 541654 | 96991 | 97006 | Intron 1 | GTCCTTAGACCCCTCA | eekddddddddddkke | 70 | 1688 |

TABLE 178-continued

Inhibition of GHR mRNA by deoxy, MOE and (S)-cEt gapmers targeting intronic regions of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541655 | 97539 | 97554 | Intron 1 | GCCCTGGCTAGAGACA | eekddddddddddkke | 39 | 1689 |
| 541656 | 98132 | 98147 | Intron 1 | CATCCAGCAGCTGGAC | eekddddddddddkke | 35 | 1690 |
| 541657 | 98833 | 98848 | Intron 1 | GACTGAGGTCATCACA | eekddddddddddkke | 60 | 1691 |
| 541658 | 99258 | 99273 | Intron 1 | GGCCAGGCACATCATG | eekddddddddddkke | 45 | 1692 |
| 541659 | 99843 | 99858 | Intron 1 | GGAGCTCATTGAGCCA | eekddddddddddkke | 36 | 1693 |
| 541660 | 100406 | 100421 | Intron 1 | GTGCCCATTGCTGTGT | eekddddddddddkke | 70 | 1694 |
| 541661 | 100742 | 100757 | Intron 1 | CCAAGTGTGGCTTCAG | eekddddddddddkke | 54 | 1695 |
| 541662 | 101305 | 101320 | Intron 1 | CCACCCTTTATACGCA | eekddddddddddkke | 87 | 1696 |
| 541663 | 101788 | 101803 | Intron 1 | CAGTAACCCCAAGGGA | eekddddddddddkke | 12 | 1697 |
| 541664 | 102649 | 102664 | Intron 1 | CCCCACCTTATATGGG | eekddddddddddkke | 9 | 1698 |
| 541665 | 103034 | 103049 | Intron 1 | AGGCCCTTTTTACATG | eekddddddddddkke | 9 | 1699 |
| 541666 | 103316 | 103331 | Intron 1 | TCAATAAGTCCCTAGG | eekddddddddddkke | 20 | 1700 |
| 541667 | 104277 | 104292 | Intron 1 | GGCATTGAGTGACTGC | eekddddddddddkke | 51 | 1701 |
| 541668 | 104679 | 104694 | Intron 1 | ATAATGCCTTCTCAGC | eekddddddddddkke | 62 | 1702 |
| 541669 | 106349 | 106364 | Intron 1 | GTGAGGCATTTAGCCC | eekddddddddddkke | 35 | 1703 |
| 541670 | 106632 | 106647 | Intron 1 | GCTCTTGTGTTGGGTA | eekddddddddddkke | 89 | 1704 |
| 541671 | 107084 | 107099 | Intron 1 | TGTGCAGGAGGTCTCA | eekddddddddddkke | 60 | 1705 |
| 541672 | 107949 | 107964 | Intron 1 | TGGAGAGTCTTGTCTC | eekddddddddddkke | 17 | 1706 |
| 541673 | 108773 | 108788 | Intron 1 | GTGACCCACCCAAGAG | eekddddddddddkke | 34 | 1707 |
| 541674 | 109336 | 109351 | Intron 1 | GTTGTAGCTAGTGTTC | eekddddddddddkke | 74 | 1708 |
| 541675 | 109849 | 109864 | Intron 1 | GCCTTAGTTTGTGCCA | eekddddddddddkke | 78 | 1709 |
| 541676 | 110427 | 110442 | Intron 1 | GCCCCAGCTGAGAATT | eekddddddddddkke | 29 | 1710 |
| 541677 | 110701 | 110716 | Intron 1 | ACAACAATCCAGGGTG | eekddddddddddkke | 61 | 1711 |
| 541678 | 110959 | 110974 | Intron 1 | CTCCCCTGGAAGTCAC | eekddddddddddkke | 59 | 1712 |
| 541679 | 111307 | 111322 | Intron 1 | GCCCTCATGGCTCAAG | eekddddddddddkke | 60 | 1713 |
| 541680 | 112499 | 112514 | Intron 1 | TCAGCAGATAGGGAGC | eekddddddddddkke | 61 | 1714 |
| 541681 | 113896 | 113911 | Intron 1 | GAATGCGGTGATCAGG | eekddddddddddkke | 29 | 1715 |
| 541682 | 117477 | 117492 | Intron 1 | CTGAGAGAATTGGCCC | eekddddddddddkke | 5 | 1716 |
| 541683 | 117740 | 117755 | Intron 1 | AGGCACATTGTTACCA | eekddddddddddkke | 26 | 1717 |
| 541684 | 118229 | 118244 | Intron 1 | GGGAGGCACTAGAGAA | eekddddddddddkke | 13 | 1718 |
| 541685 | 119269 | 119284 | Intron 1 | TACAGTAACACATCCC | eekddddddddddkke | 78 | 1719 |
| 541686 | 119688 | 119703 | Intron 1 | GAAGCTCAGCCTGATC | eekddddddddddkke | 45 | 1720 |
| 541687 | 120376 | 120391 | Intron 1 | CTTGCCTGACAACCTA | eekddddddddddkke | 53 | 1721 |
| 541688 | 120738 | 120753 | Intron 1 | GCCTACCTGCTTTTGC | eekddddddddddkke | 10 | 1722 |
| 541689 | 121242 | 121257 | Intron 1 | TTTCCCAACCACTTAG | eekddddddddddkke | 7 | 1723 |
| 541690 | 121615 | 121630 | Intron 1 | TCTCCTATTTCAGTTA | eekddddddddddkke | 23 | 1724 |

TABLE 178-continued

Inhibition of GHR mRNA by deoxy, MOE and (S)-cEt gapmers targeting intronic regions of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541691 | 121823 | 121838 | Intron 1 | GGGTGATGGATGAACT | eekddddddddddkke | 40 | 1725 |
| 541692 | 122345 | 122360 | Intron 1 | ACACTGCTGGTAGTGA | eekddddddddddkke | 0 | 1726 |
| 541693 | 122588 | 122603 | Intron 1 | ACCCAACTAGCCTGTC | eekddddddddddkke | 35 | 1727 |
| 541694 | 123152 | 123167 | Intron 1 | GAGACCTGCTGCCTGA | eekddddddddddkke | 80 | 1728 |
| 541695 | 123671 | 123686 | Intron 1 | ACATCTCTTGGGAGGT | eekddddddddddkke | 78 | 1729 |
| 541696 | 124040 | 124055 | Intron 1 | ACATAGTACCCCTCCA | eekddddddddddkke | 35 | 1730 |
| 541697 | 124430 | 124445 | Intron 1 | CTCTCAAGTACCTGCC | eekddddddddddkke | 72 | 1731 |
| 541698 | 124824 | 124839 | Intron 1 | TTTGTACCCAACCCCC | eekddddddddddkke | 15 | 1732 |
| 541699 | 125032 | 125047 | Intron 1 | AGGCCCACATAAATGC | eekddddddddddkke | 21 | 1733 |
| 541700 | 125533 | 125548 | Intron 1 | GAGCATCCCCTACACT | eekddddddddddkke | 12 | 1734 |
| 541701 | 126357 | 126372 | Intron 1 | GCTGGGCCTTTAGCTG | eekddddddddddkke | 66 | 1735 |
| 541702 | 126736 | 126751 | Intron 1 | TTGGTCAATTGGGCAG | eekddddddddddkke | 79 | 1736 |
| 541703 | 127179 | 127194 | Intron 1 | GTCTCATGAGGCCTAT | eekddddddddddkke | 60 | 1737 |
| 541704 | 127454 | 127469 | Intron 1 | GGAGGTGGGATCCCAC | eekddddddddddkke | 35 | 1738 |
| 541705 | 128467 | 128482 | Intron 1 | GCCCACTACCTAGCAC | eekddddddddddkke | 30 | 1739 |
| 541706 | 129096 | 129111 | Intron 1 | CCCAGCTGGCTGGTCG | eekddddddddddkke | 50 | 1740 |
| 541707 | 129312 | 129327 | Intron 1 | GCACCAGGTCTCCTGT | eekddddddddddkke | 7 | 1741 |
| 541708 | 129516 | 129531 | Intron 1 | GTCTAGAAGCCTAGGG | eekddddddddddkke | 23 | 1742 |
| 541709 | 129976 | 129991 | Intron 1 | GCCGGGTGTTGGTGCA | eekddddddddddkke | 50 | 1743 |
| 541710 | 130308 | 130323 | Intron 1 | TTGGTGCCTGTGTTGC | eekddddddddddkke | 49 | 1744 |
| 541711 | 130767 | 130782 | Intron 1 | TGCTTCTGATCCCTAC | eekddddddddddkke | 18 | 1745 |
| 541712 | 131286 | 131301 | Intron 1 | GTTCCCAGGAGGCTTA | eekddddddddddkke | 56 | 1746 |
| 541713 | 131676 | 131691 | Intron 1 | AGGCCCCTAGAGTCTA | eekddddddddddkke | 41 | 1747 |
| 541714 | 132292 | 132307 | Intron 1 | TGGTGTGCCCAGACTT | eekddddddddddkke | 60 | 1748 |
| 541715 | 132730 | 132745 | Intron 1 | GATGGCTAACCCACTG | eekddddddddddkke | 14 | 1749 |
| 541716 | 133101 | 133116 | Intron 1 | CCCCCAAAAGTTGCCC | eekddddddddddkke | 12 | 1750 |
| 541717 | 133522 | 133537 | Intron 1 | TAGGGTGTTCCAGATC | eekddddddddddkke | 44 | 1751 |
| 541718 | 133724 | 133739 | Intron 1 | GTACCATGAAGCTCTG | eekddddddddddkke | 67 | 1752 |
| 541719 | 134086 | 134101 | Intron 1 | CTTGGACTTGGACCAT | eekddddddddddkke | 42 | 1753 |
| 541720 | 134441 | 134456 | Intron 1 | GTGCATAGGGCCTGTC | eekddddddddddkke | 42 | 1754 |
| 541721 | 135015 | 135030 | Intron 1 | CCTCACCTGAACACCC | eekddddddddddkke | 23 | 1755 |
| 541722 | 135859 | 135874 | Intron 1 | ATGCCTCCCCGCAACT | eekddddddddddkke | 27 | 1756 |
| 541723 | 136287 | 136302 | Intron 1 | TTGTGCTTGGGTGTAC | eekddddddddddkke | 39 | 1757 |
| 541724 | 137000 | 137015 | Intron 1 | AGGCTTCATGTGAGGT | eekddddddddddkke | 86 | 1758 |

TABLE 179

Inhibition of GHR mRNA by deoxy, MOE and (S)-cEt gapmers targeting introns 1 and 2 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541262 | 156891 | 156906 | Intron 2 | TTGGTTTGTCAATCCT | eekddddddddddkke | 95 | 1370 |
| 541725 | 137372 | 137387 | Intron 1 | TGTAAAAGGTCCTCCC | eekddddddddddkke | 53 | 1759 |
| 541726 | 137750 | 137765 | Intron 1 | GACCTGTGCAGCAGGT | eekddddddddddkke | 32 | 1760 |
| 541727 | 138783 | 138798 | Intron 1 | TCCTCTTGGAGATCCA | eekddddddddddkke | 44 | 1761 |
| 541728 | 139825 | 139840 | Intron 1 | AGGTCATAGGACTGCT | eekddddddddddkke | 73 | 1762 |
| 541729 | 140343 | 140358 | Intron 1 | GAAGGTCAGACTAGGG | eekddddddddddkke | 53 | 1763 |
| 541730 | 140686 | 140701 | Intron 1 | TCTGTAGACTGCCCAG | eekddddddddddkke | 87 | 1764 |
| 541731 | 141116 | 141131 | Intron 1 | GTCCCTCTATTCCCCT | eekddddddddddkke | 57 | 1765 |
| 541732 | 141591 | 141606 | Intron 1 | AATTGCCATGCTCCCA | eekddddddddddkke | 56 | 1766 |
| 541733 | 142113 | 142128 | Intron 1 | GATGACCTTCCTCCAA | eekddddddddddkke | 15 | 1767 |
| 541734 | 142327 | 142342 | Intron 1 | GTTTCCAGTAGCACCT | eekddddddddddkke | 82 | 1768 |
| 541735 | 143118 | 143133 | Intron 1 | GGCCTTGAGCTGATGG | eekddddddddddkke | 11 | 1769 |
| 541736 | 143836 | 143851 | Intron 1 | TATCCCTAATCAGGCT | eekddddddddddkke | 40 | 1770 |
| 541737 | 144094 | 144109 | Intron 1 | GGTGTCCACATCCCGG | eekddddddddddkke | 58 | 1771 |
| 541738 | 144558 | 144573 | Intron 1 | AGCTGGACAGGCCATA | eekddddddddddkke | 27 | 1772 |
| 541740 | 145510 | 145525 | Intron 2 | GGTAATCACCCAGAGA | eekddddddddddkke | 90 | 1773 |
| 541741 | 145937 | 145952 | Intron 2 | GCGCTAAGTCTGCTGT | eekddddddddddkke | 92 | 1774 |
| 541742 | 146320 | 146335 | Intron 2 | CCTCAAATCTTGCCCA | eekddddddddddkke | 96 | 1775 |
| 541743 | 147028 | 147043 | Intron 2 | ATCCAGACCTGGCAGA | eekddddddddddkke | 84 | 1776 |
| 541744 | 147262 | 147277 | Intron 2 | ATCCCTGCTCAAGTGC | eekddddddddddkke | 89 | 1777 |
| 541745 | 147671 | 147686 | Intron 2 | CAGGCACTCCTTGGAA | eekddddddddddkke | 93 | 1778 |
| 541746 | 148139 | 148154 | Intron 2 | AGCTGAGGTATCCCTC | eekddddddddddkke | 94 | 1779 |
| 541747 | 148564 | 148579 | Intron 2 | GGGCCCAGCAAGTCTT | eekddddddddddkke | 33 | 1780 |
| 541748 | 149069 | 149084 | Intron 2 | GTTTTGTCAGTGTGCA | eekddddddddddkke | 98 | 1781 |
| 541749 | 149491 | 149506 | Intron 2 | GTGACCTGCTGAACTC | eekddddddddddkke | 95 | 1782 |
| 541750 | 150236 | 150251 | Intron 2 | GGCTGAACTGTGCACC | eekddddddddddkke | 95 | 1783 |
| 541751 | 150748 | 150763 | Intron 2 | GGGTGGTCCCACTCCT | eekddddddddddkke | 91 | 1784 |
| 541752 | 151124 | 151139 | Intron 2 | GAGGAATCCTGGGCCC | eekddddddddddkke | 94 | 1785 |
| 541753 | 151373 | 151388 | Intron 2 | ATGACAAGCTAGGTGC | eekddddddddddkke | 81 | 1786 |
| 541754 | 151644 | 151659 | Intron 2 | TTGCCAGACAGGGCAC | eekddddddddddkke | 18 | 1787 |
| 541755 | 152373 | 152388 | Intron 2 | AGACCCTCCCACTAT | eekddddddddddkke | 43 | 1788 |
| 541756 | 152617 | 152632 | Intron 2 | GGTGCTGGGTGACCGG | eekddddddddddkke | 91 | 1789 |
| 541757 | 153349 | 153364 | Intron 2 | GGCCAAACGGTGCCCT | eekddddddddddkke | 23 | 1790 |
| 541758 | 153918 | 153933 | Intron 2 | TGGGTGAATAGCAACC | eekddddddddddkke | 85 | 1791 |
| 541759 | 154171 | 154186 | Intron 2 | GCCCCCAAGGAAGTGA | eekddddddddddkke | 76 | 1792 |
| 541760 | 154813 | 154828 | Intron 2 | CAGGCTTCATGTGTGG | eekddddddddddkke | 92 | 1793 |

TABLE 179-continued

Inhibition of GHR mRNA by deoxy, MOE and (S)-cEt gapmers targeting introns 1 and 2 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541761 | 155289 | 155304 | Intron 2 | CTGTCAGTGCTTTGGT | eekddddddddddkke | 52 | 1794 |
| 541762 | 156233 | 156248 | Intron 2 | GAGTACCCTGGCAGGT | eekddddddddddkke | 58 | 1795 |
| 541763 | 156847 | 156862 | Intron 2 | TAGCTAGCACCTGGGT | eekddddddddddkke | 90 | 1796 |
| 541764 | 157552 | 157567 | Intron 2 | GGCAAACCTTTGAGCC | eekddddddddddkke | 27 | 1797 |
| 541765 | 157927 | 157942 | Intron 2 | GCTATCATTGGAGCAG | eekddddddddddkke | 94 | 1798 |
| 541766 | 158542 | 158557 | Intron 2 | CCTCTGAGTACTCCCT | eekddddddddddkke | 96 | 1799 |
| 541767 | 159252 | 159267 | Intron 2 | AGCTGAAGGCAACCAG | eekddddddddddkke | 97 | 1800 |
| 541768 | 159539 | 159554 | Intron 2 | GGGCAGTTTTCCATAG | eekddddddddddkke | 89 | 1801 |
| 541769 | 159778 | 159793 | Intron 2 | GGTCCTACCTCTGACA | eekddddddddddkke | 82 | 1802 |
| 541770 | 160352 | 160367 | Intron 2 | GGCTGCCTTAGGGTGG | eekddddddddddkke | 90 | 1803 |
| 541771 | 160812 | 160827 | Intron 2 | CGCACCTCCCCCACTA | eekddddddddddkke | 15 | 1804 |
| 541772 | 161461 | 161476 | Intron 2 | GCTTATTGGTCCATGG | eekddddddddddkke | 93 | 1805 |
| 541773 | 161821 | 161836 | Intron 2 | AACCGCAGAGCCCCCA | eekddddddddddkke | 76 | 1806 |
| 541774 | 162132 | 162147 | Intron 2 | GGGCTTGTTCTGCCAA | eekddddddddddkke | 33 | 1807 |
| 541775 | 162639 | 162654 | Intron 2 | GGGACCTGCGCTGACT | eekddddddddddkke | 86 | 1808 |
| 541776 | 163024 | 163039 | Intron 2 | CTTTCACCTGGTGACT | eekddddddddddkke | 83 | 1809 |
| 541777 | 163542 | 163557 | Intron 2 | AGCTTGAGGGAGTATA | eekddddddddddkke | 52 | 1810 |
| 541778 | 164144 | 164159 | Intron 2 | GCCTGCTCAATTGAGG | eekddddddddddkke | 32 | 1811 |
| 541779 | 164570 | 164585 | Intron 2 | ATAGCAGCTGGCTGCC | eekddddddddddkke | 24 | 1812 |
| 541780 | 165419 | 165434 | Intron 2 | AAAAGCTTGGCACCCC | eekddddddddddkke | 91 | 1813 |
| 541781 | 165859 | 165874 | Intron 2 | CCTGGCAAGAAGGGCC | eekddddddddddkke | 65 | 1814 |
| 541782 | 166435 | 166450 | Intron 2 | TTAGCCCATCTATCCC | eekddddddddddkke | 82 | 1815 |
| 541783 | 166837 | 166852 | Intron 2 | GTGGTCTCCCTGTGCC | eekddddddddddkke | 90 | 1816 |
| 541784 | 167107 | 167122 | Intron 2 | AGCCCTCTCTGGCAAA | eekddddddddddkke | 38 | 1817 |
| 541785 | 168004 | 168019 | Intron 2 | TTACTGTGGCCCGAGT | eekddddddddddkke | 94 | 1818 |
| 541786 | 169062 | 169077 | Intron 2 | GTAGACTCCTAGGGTC | eekddddddddddkke | 90 | 1819 |
| 541787 | 169696 | 169711 | Intron 2 | CCTCCAGTTAGTGTGC | eekddddddddddkke | 91 | 1820 |
| 541788 | 170081 | 170096 | Intron 2 | GTGGGTGGCCAACAGG | eekddddddddddkke | 91 | 1821 |
| 541789 | 170799 | 170814 | Intron 2 | GGGATTCCCTGGTAGC | eekddddddddddkke | 77 | 1822 |
| 541790 | 171021 | 171036 | Intron 2 | GTGAGACCGGCCTTTG | eekddddddddddkke | 23 | 1823 |
| 541791 | 171530 | 171545 | Intron 2 | ACTGGCACCCACTTGG | eekddddddddddkke | 54 | 1824 |
| 541792 | 172447 | 172462 | Intron 2 | ATTGGCCTAATGCCCC | eekddddddddddkke | 76 | 1825 |
| 541793 | 172733 | 172748 | Intron 2 | AGGCTATACATTCCAG | eekddddddddddkke | 94 | 1826 |
| 541794 | 173045 | 173060 | Intron 2 | GGTGGCAGCTAGGTGG | eekddddddddddkke | 80 | 1827 |
| 541795 | 173677 | 173692 | Intron 2 | TCCACAGTTGGCACTG | eekddddddddddkke | 77 | 1828 |
| 541796 | 174128 | 174143 | Intron 2 | TGGGCCTTAGATTGTA | eekddddddddddkke | 69 | 1829 |

TABLE 179-continued

Inhibition of GHR mRNA by deoxy, MOE and (S)-cEt gapmers targeting introns 1 and 2 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541797 | 174521 | 174536 | Intron 2 | TGTCTTCCTGGTGGCC | eekddddddddddkke | 97 | 1830 |
| 541798 | 174870 | 174885 | Intron 2 | CCCGCCTCTCCAGCAA | eekddddddddddkke | 89 | 1831 |
| 541799 | 175275 | 175290 | Intron 2 | GCAGCAGCCAATAAGT | eekddddddddddkke | 76 | 1832 |
| 541800 | 175691 | 175706 | Intron 2 | TTGTATCCTGGCCCCT | eekddddddddddkke | 80 | 1833 |
| 541801 | 176038 | 176053 | Intron 2 | GCCTCATGGGCCTTAC | eekddddddddddkke | 66 | 1834 |

TABLE 180

Inhibition of GHR mRNA by deoxy, MOE and (S)-cEt gapmers targeting introns 2 and 3 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541262 | 156891 | 156906 | Intron 2 | TTGGTTTGTCAATCCT | eekddddddddddkke | 97 | 1370 |
| 541802 | 176619 | 176634 | Intron 2 | GGATGCCAGTCTTGGC | eekddddddddddkke | 48 | 1835 |
| 541803 | 176835 | 176850 | Intron 2 | CTGCTCTCAGTACCTC | eekddddddddddkke | 87 | 1836 |
| 541804 | 177300 | 177315 | Intron 2 | ACCCAAGAAGTCACCT | eekddddddddddkke | 93 | 1837 |
| 541805 | 177551 | 177566 | Intron 2 | GCCTCAAGCCCTACCC | eekddddddddddkke | 73 | 1838 |
| 541806 | 178066 | 178081 | Intron 2 | AGCTCCAGCCTATAGA | eekddddddddddkke | 81 | 1839 |
| 541807 | 178361 | 178376 | Intron 2 | GGTCCACATGGCCCTA | eekddddddddddkke | 90 | 1840 |
| 541808 | 178895 | 178910 | Intron 2 | CAGGCCCAGGATTGTC | eekddddddddddkke | 81 | 1841 |
| 541809 | 179444 | 179459 | Intron 2 | GGGCCTGCTTTGCAGC | eekddddddddddkke | 81 | 1842 |
| 541810 | 179863 | 179878 | Intron 2 | ACTCCTCTCTTTAGGC | eekddddddddddkke | 87 | 1843 |
| 541811 | 180524 | 180539 | Intron 2 | CTGGGTAACAGTCCTC | eekddddddddddkke | 98 | 1844 |
| 541812 | 181528 | 181543 | Intron 2 | ACTGTATGGTTTCCAC | eekddddddddddkke | 83 | 1845 |
| 541813 | 182103 | 182118 | Intron 2 | GCCAAAGATAGCTCTT | eekddddddddddkke | 94 | 1846 |
| 541814 | 182978 | 182993 | Intron 2 | GGCATTGGAAGTTGGT | eekddddddddddkke | 87 | 1847 |
| 541815 | 183193 | 183208 | Intron 2 | CCCTTCCTGACCTTAC | eekddddddddddkke | 55 | 1848 |
| 541816 | 183658 | 183673 | Intron 2 | TTACCCTCTATTCACC | eekddddddddddkke | 65 | 1849 |
| 541818 | 184501 | 184516 | Intron 2 | GGCACCCCAGGCCGGG | eekddddddddddkke | 25 | 1850 |
| 541819 | 185080 | 185095 | Intron 2 | CAGCAGCTAGTTCCCC | eekddddddddddkke | 96 | 1851 |
| 541820 | 185327 | 185342 | Intron 2 | GTGGGCACTAGTGTGT | eekddddddddddkke | 75 | 1852 |
| 541821 | 185682 | 185697 | Intron 2 | TGCCCTTGTCAGGGCA | eekddddddddddkke | 20 | 1853 |
| 541822 | 186025 | 186040 | Intron 2 | GCAGATAGGCTCAGCA | eekddddddddddkke | 98 | 1854 |
| 541823 | 186570 | 186585 | Intron 2 | CCCTAGCCCTTAGCAC | eekddddddddddkke | 44 | 1855 |
| 541824 | 186841 | 186856 | Intron 2 | ACTGGAATGGCCCTCT | eekddddddddddkke | 86 | 1856 |
| 541825 | 187176 | 187191 | Intron 2 | TTTGCTCATGCTCACA | eekddddddddddkke | 96 | 1857 |
| 541826 | 187629 | 187644 | Intron 2 | GCCTTTGTGTGTCACT | eekddddddddddkke | 99 | 1858 |

TABLE 180-continued

Inhibition of GHR mRNA by deoxy, MOE and (S)-cEt gapmers targeting introns 2 and 3 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541827 | 187857 | 187872 | Intron 2 | TATGTGGTAGCATGTC | eekddddddddddkke | 96 | 1859 |
| 541828 | 188442 | 188457 | Intron 2 | CCCCAGGAAGTTGGCC | eekddddddddddkke | 68 | 1860 |
| 541829 | 189086 | 189101 | Intron 2 | TAGCTGTCAAGGCCCT | eekddddddddddkke | 90 | 1861 |
| 541830 | 189534 | 189549 | Intron 2 | CCTAGTCAGCCACTAG | eekddddddddddkke | 20 | 1862 |
| 541831 | 189889 | 189904 | Intron 2 | AGACTCCCCATCAGCC | eekddddddddddkke | 74 | 1863 |
| 541832 | 190172 | 190187 | Intron 2 | GTGAAGGGCCTTCATC | eekddddddddddkke | 68 | 1864 |
| 541833 | 190961 | 190976 | Intron 2 | GGTTGAGAGTCCAATG | eekddddddddddkke | 95 | 1865 |
| 541834 | 191404 | 191419 | Intron 2 | CAGCTAATTCCCTCAT | eekddddddddddkke | 79 | 1866 |
| 541835 | 191614 | 191629 | Intron 2 | TTGTGTCTCAACCCAC | eekddddddddddkke | 95 | 1867 |
| 541836 | 191999 | 192014 | Intron 2 | GGCTATGCTGCATGCT | eekddddddddddkke | 91 | 1868 |
| 541837 | 192860 | 192875 | Intron 2 | CCCCATACCCAGTGGA | eekddddddddddkke | 71 | 1869 |
| 541838 | 193460 | 193475 | Intron 2 | GGTGGTTTTCCTCCCT | eekddddddddddkke | 95 | 1870 |
| 541839 | 194144 | 194159 | Intron 2 | GAGCCTGCCCAACTTT | eekddddddddddkke | 90 | 1871 |
| 541840 | 194425 | 194440 | Intron 2 | TGATGCCCAAGAGTGA | eekddddddddddkke | 85 | 1872 |
| 541841 | 194953 | 194968 | Intron 2 | TTCCCTCTGCGAACAT | eekddddddddddkke | 96 | 1873 |
| 541842 | 195428 | 195443 | Intron 2 | GTTCCATCTCAATCCA | eekddddddddddkke | 94 | 1874 |
| 541843 | 196858 | 196873 | Intron 2 | ACGGCCACTCCACTGG | eekddddddddddkke | 44 | 1875 |
| 541844 | 197326 | 197341 | Intron 2 | TGGAAGTGGTTCCAGA | eekddddddddddkke | 90 | 1876 |
| 541845 | 197946 | 197961 | Intron 2 | TTGCCCCAGACCAACA | eekddddddddddkke | 47 | 1877 |
| 541846 | 198366 | 198381 | Intron 2 | GAGGTTGTGGAGGTGC | eekddddddddddkke | 26 | 1878 |
| 541847 | 198715 | 198730 | Intron 2 | GAGTTGCTGTGTGTGA | eekddddddddddkke | 83 | 1879 |
| 541848 | 198939 | 198954 | Intron 2 | CATGTCAGAGGTGTCC | eekddddddddddkke | 93 | 1880 |
| 541849 | 199506 | 199521 | Intron 2 | AGGTAAGGATCATGGC | eekddddddddddkke | 87 | 1881 |
| 541850 | 199816 | 199831 | Intron 2 | GTTCAGTTGCATCACG | eekddddddddddkke | 90 | 1882 |
| 541851 | 200249 | 200264 | Intron 2 | GCCCAGCTAGCCACCC | eekddddddddddkke | 68 | 1883 |
| 541852 | 201258 | 201273 | Intron 2 | CCTTAGCAGCCAGGCC | eekddddddddddkke | 86 | 1884 |
| 541853 | 202079 | 202094 | Intron 2 | GCACTTAGGGTTTTGC | eekddddddddddkke | 94 | 1885 |
| 541854 | 202382 | 202397 | Intron 2 | GTTGAACTTTCCCTAC | eekddddddddddkke | 53 | 1886 |
| 541855 | 202702 | 202717 | Intron 2 | TGACTCCTTGAGACAG | eekddddddddddkke | 83 | 1887 |
| 541856 | 203098 | 203113 | Intron 2 | TGCGCTGGCTTAGCAA | eekddddddddddkke | 59 | 1888 |
| 541857 | 203464 | 203479 | Intron 2 | GGCCTAACATCAGCAG | eekddddddddddkke | 88 | 1889 |
| 541858 | 204212 | 204227 | Intron 2 | ACTCCTCCCAGTTAGC | eekddddddddddkke | 70 | 1890 |
| 541859 | 205630 | 205645 | Intron 2 | ACCAGTGGCCAATGTC | eekddddddddddkke | 92 | 1891 |
| 541861 | 206422 | 206437 | Intron 2 | GCCTAGACACAGTAGG | eekddddddddddkke | 70 | 1892 |

TABLE 180-continued

Inhibition of GHR mRNA by deoxy, MOE and (S)-cEt gapmers targeting introns 2 and 3 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541862 | 206749 | 206764 | Intron 2 | TATTCTCCCCCTAGGG | eekddddddddddkke | 42 | 1893 |
| 541863 | 207517 210196 | 207532 210211 | Intron 2 | GACGGCCTTGGGCACA | eekddddddddddkke | 96 | 1894 |
| 541865 | 208659 | 208674 | Intron 3 | GCAGGCTGTATTAGCA | eekddddddddddkke | 15 | 1895 |
| 541867 | 209999 | 210014 | Intron 3 | ACCCCCTATCCTGCAC | eekddddddddddkke | 58 | 1896 |
| 541868 | 210281 211033 | 210296 211048 | Intron 3 | TCCTCCATACCTAGAG | eekddddddddddkke | 61 | 1897 |
| 541869 | 210502 | 210517 | Intron 3 | GATAGGTGCCCACTGT | eekddddddddddkke | 80 | 1898 |
| 541870 | 210920 | 210935 | Intron 3 | GTCAGTTCTGGCTAGG | eekddddddddddkke | 97 | 1899 |
| 541871 | 211269 | 211284 | Intron 3 | GCCTGAACTTACAAGC | eekddddddddddkke | 68 | 1900 |
| 541872 | 211836 | 211851 | Intron 3 | ACCCTGGGCTGACCTT | eekddddddddddkke | 92 | 1901 |
| 541873 | 212606 | 212621 | Intron 3 | GGACCTGGACAAGCAA | eekddddddddddkke | 97 | 1902 |
| 541874 | 213099 | 213114 | Intron 3 | CTCCTTGCGAGAGAGG | eekddddddddddkke | 7 | 1903 |
| 541875 | 213425 | 213440 | Intron 3 | AGAGTTGACATGGGCA | eekddddddddddkke | 96 | 1904 |
| 541876 | 213846 | 213861 | Intron 3 | CACTAGGTCCCTGACC | eekddddddddddkke | 37 | 1905 |
| 541877 | 214483 | 214498 | Intron 3 | CACTCTCTTGGGCTGT | eekddddddddddkke | 94 | 1906 |
| 541878 | 214884 | 214899 | Intron 3 | AGGGACCTGCATTCCA | eekddddddddddkke | 72 | 1907 |

TABLE 181

Inhibition of GHR mRNA by deoxy, MOE and (S)-cEt gapmers targeting introns 2 and 3 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541262 | 156891 | 156906 | Intron 2 | TTGGTTTGTCAATCCT | eekddddddddddkke | 91 | 1370 |
| 541879 | 215493 | 215508 | Intron 3 | TTCACCACCCATTGGG | eekddddddddddkke | 63 | 1908 |
| 541880 | 216192 | 216207 | Intron 3 | ATCTGGTCTGAGGGCC | eekddddddddddkke | 92 | 1909 |
| 541881 | 216458 | 216473 | Intron 3 | GACATGCAATTGACCC | eekddddddddddkke | 98 | 1910 |
| 541882 | 217580 | 217595 | Intron 3 | GTGTGCAGCAGACTGT | eekddddddddddkke | 92 | 1911 |
| 541883 | 218233 | 218248 | Intron 3 | GACAGTCCAGCTGCAA | eekddddddddddkke | 84 | 1912 |
| 541884 | 218526 | 218541 | Intron 3 | CCTGCGGCAGTGAAGA | eekddddddddddkke | 85 | 1913 |
| 541885 | 218734 | 218749 | Intron 3 | CTCTGAGGATAACCCT | eekddddddddddkke | 76 | 1914 |
| 541886 | 219342 | 219357 | Intron 3 | GTTCCCAGCTCCCCAA | eekddddddddddkke | 68 | 1915 |
| 541887 | 219618 | 219633 | Intron 3 | TAGGGTCAGTGTCCCA | eekddddddddddkke | 79 | 1916 |
| 541888 | 220039 | 220054 | Intron 3 | GGCGAGCCTCTCAGCC | eekddddddddddkke | 52 | 1917 |
| 541889 | 220393 | 220408 | Intron 3 | GACTCATCCAGGCAGT | eekddddddddddkke | 91 | 1918 |
| 541890 | 220665 | 220680 | Intron 3 | TCCCTCCCTTAGGCAC | eekddddddddddkke | 71 | 1919 |
| 541891 | 221044 | 221059 | Intron 3 | GAGGAGCCAGGCATAT | eekddddddddddkke | 80 | 1920 |

TABLE 181-continued

Inhibition of GHR mRNA by deoxy, MOE and (S)-cEt gapmers targeting introns 2 and 3 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541892 | 221562 | 221577 | Intron 3 | CACCAACGAAGTCCCC | eekddddddddddkke | 89 | 1921 |
| 541893 | 221947 | 221962 | Intron 3 | GCTGGCAGTCACCAAA | eekddddddddddkke | 90 | 1922 |
| 541894 | 222569 | 222584 | Intron 3 | GCCCACACCATTGAGC | eekddddddddddkke | 70 | 1923 |
| 541895 | 222983 | 222998 | Intron 3 | AGTGAGATGCCCTGGT | eekddddddddddkke | 92 | 1924 |
| 541896 | 223436 | 223451 | Intron 3 | CACTGGCAGTTAGACC | eekddddddddddkke | 88 | 1925 |
| 541897 | 224107 | 224122 | Intron 3 | ACTCTGGCCACTAGTA | eekddddddddddkke | 80 | 1926 |
| 541898 | 224731 | 224746 | Intron 3 | GGTAGGGTGGCCACAT | eekddddddddddkke | 78 | 1927 |
| 541899 | 225133 | 225148 | Intron 3 | GAGCCATGTCTAGGCA | eekddddddddddkke | 18 | 1928 |
| 541900 | 225465 | 225480 | Intron 3 | CAGACTGAAACCCACC | eekddddddddddkke | 86 | 1929 |
| 541901 | 225671 | 225686 | Intron 3 | TATGGTCCAGCCACCA | eekddddddddddkke | 76 | 1930 |
| 541902 | 226110 | 226125 | Intron 3 | TACCTCCTCTGTTGGT | eekddddddddddkke | 36 | 1931 |
| 541903 | 227025 | 227040 | Intron 3 | ACACCTCAGTCATGAT | eekddddddddddkke | 92 | 1932 |
| 541904 | 227236 | 227251 | Intron 3 | AACAGGCTTCAAGAGG | eekddddddddddkke | 91 | 1933 |
| 541905 | 227485 | 227500 | Intron 3 | GTACTACTGGCCATGT | eekddddddddddkke | 73 | 1934 |
| 541906 | 227914 | 227929 | Intron 3 | CTGCAGGCGGTTGCTA | eekddddddddddkke | 60 | 1935 |
| 541907 | 228718 | 228733 | Intron 3 | GTCTGTTGCCAAGAGC | eekddddddddddkke | 95 | 1936 |
| 541908 | 229174 | 229189 | Intron 3 | CCCTGGGTCACTTAAG | eekddddddddddkke | 44 | 1937 |
| 541909 | 229423 | 229438 | Intron 3 | CCTGTCCTTGCTTGCA | eekddddddddddkke | 96 | 1938 |
| 541910 | 230042 | 230057 | Intron 3 | GCCCAGCTTATCCTAA | eekddddddddddkke | 78 | 1939 |
| 541911 | 230313 | 230328 | Intron 3 | AGTAGAGCCTTTGCCT | eekddddddddddkke | 75 | 1940 |
| 541912 | 230580 | 230595 | Intron 3 | CTGTCTCTTGGCCCAT | eekddddddddddkke | 80 | 1941 |
| 541913 | 231330 | 231345 | Intron 3 | GGCCCAAATCTTGAGT | eekddddddddddkke | 67 | 1942 |
| 541914 | 231817 | 231832 | Intron 3 | GCTTGTTACAGCACTA | eekddddddddddkke | 92 | 1943 |
| 541915 | 232088 | 232103 | Intron 3 | ACTTTGGCCCAGAGAT | eekddddddddddkke | 51 | 1944 |
| 541916 | 232884 | 232899 | Intron 3 | GCAGTCAGGTCAGCTG | eekddddddddddkke | 75 | 1945 |
| 541917 | 233210 | 233225 | Intron 3 | GCCTTGTCCTACTACC | eekddddddddddkke | 65 | 1946 |
| 541918 | 233657 | 233672 | Intron 3 | GGCTCTGCTATTGGCC | eekddddddddddkke | 59 | 1947 |
| 541919 | 233998 | 234013 | Intron 3 | CTTATAGAGCCTTGCC | eekddddddddddkke | 59 | 1948 |
| 541920 | 234296 | 234311 | Intron 3 | GGAAGGGCCCAAATAT | eekddddddddddkke | 15 | 1949 |
| 541921 | 234903 | 234918 | Intron 3 | GATCTACTCCTACTGC | eekddddddddddkke | 65 | 1950 |
| 541922 | 235313 | 235328 | Intron 3 | GTCAGCCTGTGTCTGA | eekddddddddddkke | 45 | 1951 |
| 541923 | 235770 | 235785 | Intron 3 | AGCTTCCTCCTTACAC | eekddddddddddkke | 54 | 1952 |
| 541924 | 236198 | 236213 | Intron 3 | CTGCTAAGCCCCTACC | eekddddddddddkke | 59 | 1953 |
| 541925 | 236684 | 236699 | Intron 3 | AGAGGTCAGGTGCATA | eekddddddddddkke | 77 | 1954 |
| 541926 | 237055 | 237070 | Intron 3 | TTCAGCCTGGTTGGGA | eekddddddddddkke | 71 | 1955 |
| 541927 | 237585 | 237600 | Intron 3 | GATTGATTGAGCTCCT | eekddddddddddkke | 86 | 1956 |

TABLE 181-continued

Inhibition of GHR mRNA by deoxy, MOE and (S)-cEt gapmers targeting introns 2 and 3 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541928 | 237949 | 237964 | Intron 3 | ATGGACTCCCTAGGCT | eekddddddddddkke | 61 | 1957 |
| 541929 | 238542 | 238557 | Intron 3 | TACTCAAGGGCCCCTC | eekddddddddddkke | 67 | 1958 |
| 541930 | 245319 | 245334 | Intron 3 | GGCATATGTAGCTTGC | eekddddddddddkke | 91 | 1959 |
| 541931 | 245765 | 245780 | Intron 3 | GAGCTTAGATCTGTGC | eekddddddddddkke | 73 | 1960 |
| 541932 | 246251 | 246266 | Intron 3 | ATGCTCACGGCTGTGT | eekddddddddddkke | 81 | 1961 |
| 541933 | 246500 | 246515 | Intron 3 | ATTGAAAGGCCCCATCA | eekddddddddddkke | 45 | 1962 |
| 541934 | 246936 | 246951 | Intron 3 | CAACCCAGTTTGCCGG | eekddddddddddkke | 71 | 1963 |
| 541935 | 247225 | 247240 | Intron 3 | CAGCTATTCCCTGTTT | eekddddddddddkke | 53 | 1964 |
| 541936 | 247644 | 247659 | Intron 3 | GCTGTGTCACACTTCC | eekddddddddddkke | 98 | 1965 |
| 541937 | 248223 | 248238 | Intron 3 | GTCCAAGGATCACAGC | eekddddddddddkke | 86 | 1966 |
| 541938 | 248695 | 248710 | Intron 3 | GCTACCACTAGAGCCT | eekddddddddddkke | 81 | 1967 |
| 541939 | 249494 | 249509 | Intron 3 | GTTTCAGGGCTTATGT | eekddddddddddkke | 63 | 1968 |
| 541940 | 250693 | 250708 | Intron 3 | TCCCACACCTATTGAA | eekddddddddddkke | 51 | 1969 |
| 541941 | 251622 | 251637 | Intron 3 | ACTGACTAGAGAGTCC | eekddddddddddkke | 81 | 1970 |
| 541942 | 251950 | 251965 | Intron 3 | TCCAAGGCTGATGTCC | eekddddddddddkke | 85 | 1971 |
| 541943 | 252665 | 252680 | Intron 3 | TCCCATGGTGGACATG | eekddddddddddkke | 39 | 1972 |
| 541944 | 253140 | 253155 | Intron 3 | AGTAGCTGGCAGAAGG | eekddddddddddkke | 85 | 1973 |
| 541945 | 253594 | 253609 | Intron 3 | CTGGGAGTGACTACTA | eekddddddddddkke | 77 | 1974 |
| 541946 | 254036 | 254051 | Intron 3 | TGGTATAGCTACTGGG | eekddddddddddkke | 84 | 1975 |
| 541947 | 254905 | 254920 | Intron 3 | CTGTGGTTTGGCAGGT | eekddddddddddkke | 90 | 1976 |
| 541948 | 255407 | 255422 | Intron 3 | GTTCTCACCTGAACTA | eekddddddddddkke | 65 | 1977 |
| 541949 | 255618 | 255633 | Intron 3 | ATAGGCTACTGGCAGG | eekddddddddddkke | 89 | 1978 |
| 541950 | 255992 | 256007 | Intron 3 | CCCAGCTAGCTGGAGT | eekddddddddddkke | 50 | 1979 |
| 541951 | 256428 | 256443 | Intron 3 | GGCTGGCTCTCAAAGG | eekddddddddddkke | 61 | 1980 |
| 541952 | 256689 | 256704 | Intron 3 | TGGTGATACTGTGGCA | eekddddddddddkke | 94 | 1981 |
| 541953 | 257317 | 257332 | Intron 3 | GCTGATTTTGGTGCCA | eekddddddddddkke | 92 | 1982 |
| 541954 | 257826 | 257841 | Intron 3 | GCTAATCTTGCCTCGA | eekddddddddddkke | 52 | 1983 |
| 541955 | 258407 | 258422 | Intron 3 | CACTGGTGGCTTTCAA | eekddddddddddkke | 31 | 1984 |

TABLE 182

Inhibition of GHR mRNA by deoxy, MOE and (S)-cEt gapmers
targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541262 | n/a | Intron 2 | TTGGTTTGTCAATCCT | eekddddddddddkke | 93 | 156891 | 1370 |
| 541956 | n/a | Intron 3 | GTCCCCTTCTTAAGCA | eekddddddddddkke | 56 | 258980 | 1985 |
| 541957 | n/a | Intron 3 | GCCAGGCCAACTGTGG | eekddddddddddkke | 53 | 259290 | 1986 |
| 541958 | n/a | Intron 3 | GGCCCGTTATGGTGGA | eekddddddddddkke | 72 | 259500 | 1987 |
| 541959 | n/a | Intron 3 | CCTAAAGTCCAACTCC | eekddddddddddkke | 76 | 261641 | 1988 |
| 541960 | n/a | Intron 3 | CCCTATCCAGCCTTCA | eekddddddddddkke | 77 | 262021 | 1989 |
| 541961 | n/a | Intron 3 | AAGCATGGCCTCTGGC | eekddddddddddkke | 23 | 262453 | 1990 |
| 541962 | n/a | Intron 3 | TACCCTGCACCCTCCT | eekddddddddddkke | 71 | 262764 | 1991 |
| 541963 | n/a | Intron 3 | TCCTTAGTAGAATGCC | eekddddddddddkke | 82 | 263342 | 1992 |
| 541964 | n/a | Intron 3 | TTAGCCCTGGGAGCAC | eekddddddddddkke | 78 | 263913 | 1993 |
| 541965 | n/a | Intron 3 | GCTGGGTCAGGTAGCG | eekddddddddddkke | 71 | 266503 | 1994 |
| 541966 | n/a | Intron 3 | GGGAGGCTCTCAATCT | eekddddddddddkke | 75 | 266861 | 1995 |
| 541967 | n/a | Intron 3 | GTAAGTGCAGAATGCC | eekddddddddddkke | 87 | 267116 | 1996 |
| 541968 | n/a | Intron 3 | TGCCGAGGCAGGCACC | eekddddddddddkke | 33 | 267380 | 1997 |
| 541969 | n/a | Intron 3 | TCCGTGTCTAGGAGGT | eekddddddddddkke | 84 | 267865 | 1998 |
| 541970 | n/a | Intron 4 | GTCTCCCTGCATTGGA | eekddddddddddkke | 31 | 268366 | 1999 |
| 541971 | n/a | Intron 4 | CCATATCACTCTCCTC | eekddddddddddkke | 79 | 268786 | 2000 |
| 541972 | n/a | Intron 4 | CGAACACCTTGAGCCA | eekddddddddddkke | 90 | 269252 | 2001 |
| 541973 | n/a | Intron 4 | GGCCCAGCTTAAGAGG | eekddddddddddkke | 59 | 270038 | 2002 |
| 541974 | n/a | Intron 4 | CTGATACTCCTAATCC | eekddddddddddkke | 70 | 270501 | 2003 |
| 541975 | n/a | Intron 4 | GCCTGTAGGGCTGTGC | eekddddddddddkke | 82 | 270817 | 2004 |
| 541976 | n/a | Intron 4 | TGCCCTTTCTCCCTAC | eekddddddddddkke | 87 | 271216 | 2005 |
| 541977 | n/a | Intron 4 | AGTGCATGTCAGTACC | eekddddddddddkke | 75 | 271812 | 2006 |
| 541978 | n/a | Intron 4 | TGCTCCTCAGCTGTTG | eekddddddddddkke | 44 | 272631 | 2007 |
| 541979 | n/a | Intron 4 | GTTTGGGACCATCCCT | eekddddddddddkke | 41 | 272834 | 2008 |
| 541980 | n/a | Intron 4 | AGTGCTCTCTAGGGTC | eekddddddddddkke | 87 | 273257 | 2009 |
| 541981 | n/a | Intron 4 | TACAGAGAATCACCCC | eekddddddddddkke | 82 | 273651 | 2010 |
| 541982 | n/a | Intron 4 | GTCCAAGTAAGGTGCT | eekddddddddddkke | 57 | 273947 | 2011 |
| 541983 | n/a | Intron 5 | GACCTTGCAGGCTTCC | eekddddddddddkke | 87 | 274244 | 2012 |
| 541984 | n/a | Intron 5 | GGGCAAAGGATCCTCT | eekddddddddddkke | 71 | 274758 | 2013 |
| 541985 | n/a | Intron 5 | CCCATTCTGCTATCCC | eekddddddddddkke | 92 | 275198 | 2014 |
| 541986 | n/a | Intron 5 | GCTGACTAGGAGGGCT | eekddddddddddkke | 62 | 275732 | 2015 |
| 541987 | n/a | Intron 5 | CCTGTGAGGTAGTACC | eekddddddddddkke | 83 | 276309 | 2016 |
| 541988 | n/a | Intron 5 | GTCCCCCTCCAGTCTA | eekddddddddddkke | 50 | 276932 | 2017 |
| 541989 | n/a | Intron 5 | GAGGACTCAATTCCTC | eekddddddddddkke | 0 | 277149 | 2018 |
| 541990 | n/a | Intron 5 | GACAAGGTCCTTTTGG | eekddddddddddkke | 43 | 277391 | 2019 |

TABLE 182-continued

Inhibition of GHR mRNA by deoxy, MOE and (S)-cEt gapmers targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541991 | n/a | Intron 5 | GCTCTTGTGTGCACCC | eekddddddddddkke | 90 | 277730 | 2020 |
| 541992 | n/a | Intron 5 | TCACCGCCTGCACCAC | eekddddddddddkke | 75 | 278342 | 2021 |
| 541993 | n/a | Intron 5 | GGTTGCACTGTGCAAT | eekddddddddddkke | 26 | 278917 | 2022 |
| 541994 | n/a | Intron 6 | TTCCACAGGCCTCCAT | eekddddddddddkke | 64 | 279303 | 2023 |
| 541995 | n/a | Intron 6 | GCTGAGTTCCATATGC | eekddddddddddkke | 72 | 279679 | 2024 |
| 541996 | n/a | Intron 6 | GAACCGCCACCTCAGG | eekddddddddddkke | 38 | 280157 | 2025 |
| 541997 | n/a | Intron 6 | GCTCACGGTTGGAGAC | eekddddddddddkke | 42 | 280799 | 2026 |
| 541998 | n/a | Intron 6 | TGGGCTCCCATGTTCA | eekddddddddddkke | 45 | 281595 | 2027 |
| 541999 | n/a | Intron 6 | TCACTCTACCAACCTC | eekddddddddddkke | 33 | 282572 | 2028 |
| 542000 | n/a | Intron 6 | TCCTTGCTTACAGATG | eekddddddddddkke | 33 | 283079 | 2029 |
| 542001 | n/a | Intron 6 | TGATGCTAGCATTACC | eekddddddddddkke | 37 | 283653 | 2030 |
| 542002 | n/a | Intron 6 | TGGGTAACTGGCTAGT | eekddddddddddkke | 47 | 285711 | 2031 |
| 542003 | n/a | Intron 6 | AACCATTCCTCACCAA | eekddddddddddkke | 53 | 287181 | 2032 |
| 542004 | n/a | Intron 6 | GCCCTGAACAGTTGAT | eekddddddddddkke | 37 | 287895 | 2033 |
| 542005 | n/a | Intron 6 | GGCTCCTATCATACCT | eekddddddddddkke | 38 | 288943 | 2034 |
| 542006 | n/a | Intron 6 | TAGGTCTCACAACCCT | eekddddddddddkke | 10 | 289638 | 2035 |
| 542007 | n/a | Intron 6 | GTGCATTAGTCTTCCA | eekddddddddddkke | 74 | 290035 | 2036 |
| 542008 | n/a | Intron 7 | CAAAAGCCAGGTTAGC | eekddddddddddkke | 13 | 290503 | 2037 |
| 542009 | n/a | Intron 7 | CTGCTGTTGACTACCT | eekddddddddddkke | 50 | 290924 | 2038 |
| 542010 | n/a | Intron 7 | GTACCTGCCAGCTACT | eekddddddddddkke | 35 | 291807 | 2039 |
| 542011 | n/a | Exon 8-intron 8 junction | CCTACCTTTGCTGTTT | eekddddddddddkke | 12 | 292611 | 2040 |
| 542012 | n/a | Intron 8 | AGTCACCAGCCTAAGC | eekddddddddddkke | 47 | 292860 | 2041 |
| 542013 | n/a | Intron 8 | AGGCAACCTGGGAGTG | eekddddddddddkke | 52 | 293377 | 2042 |
| 542014 | n/a | Intron 8 | TGGCCTTCACAATGGC | eekddddddddddkke | 33 | 294052 | 2043 |
| 542015 | n/a | Intron 8 | GGTGAAGTGGGTTGGA | eekddddddddddkke | 27 | 294536 | 2044 |
| 542016 | n/a | Intron 8 | GCTGGTTGTCTGCTGC | eekddddddddddkke | 60 | 294931 | 2045 |
| 542017 | n/a | Intron 8 | AGTTTGTGACCCCTGC | eekddddddddddkke | 81 | 295475 | 2046 |
| 542018 | n/a | Intron 8 | CCACTCAGTGTGAATG | eekddddddddddkke | 85 | 295955 | 2047 |
| 542019 | n/a | Intron 8 | CTGGCCTCAGGGCAAT | eekddddddddddkke | 51 | 296186 | 2048 |
| 542020 | n/a | Intron 8 | GTAGACTTGGGTAGGT | eekddddddddddkke | 53 | 296680 | 2049 |
| 542022 | n/a | 3'UTR | TGGTGCTAAGCTCTCC | eekddddddddddkke | 67 | 301009 | 2050 |
| 542023 | n/a | 3'UTR | CATGCTCAAGCTGGAA | eekddddddddddkke | 47 | 301280 | 2051 |
| 542024 | 206 | Exon 2 | AAGGTCAACAGCAGCT | eekddddddddddkke | 93 | 144990 | 2052 |

TABLE 182-continued

Inhibition of GHR mRNA by deoxy, MOE and (S)-cEt gapmers
targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 542025 | 207 | Exon 2 | CAAGGTCAACAGCAGC | eekddddddddddkke | 85 | 144991 | 2053 |
| 542026 | 208 | Exon 2 | CCAAGGTCAACAGCAG | eekddddddddddkke | 82 | 144992 | 2054 |
| 542027 | 209 | Exon 2 | GCCAAGGTCAACAGCA | eekddddddddddkke | 84 | 144993 | 2055 |

TABLE 183

Inhibition of GHR mRNA by deoxy, MOE and (S)-cEt gapmers
targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541262 | n/a | Intron 2 | TTGGTTTGTCAATCCT | eekddddddddddkke | 86 | 156891 | 1370 |
| 542034 | 870 | Exon 7 | TCTCACACGCACTTCA | eekddddddddddkke | 49 | 290368 | 2056 |
| 542035 | 871 | Exon 7 | ATCTCACACGCACTTC | eekddddddddddkke | 39 | 290369 | 2057 |
| 542036 | 872 | Exon 7 | GATCTCACACGCACTT | eekddddddddddkke | 50 | 290370 | 2058 |
| 542049 | n/a | Intron 1 | CTTTCATGAATCAAGC | eekddddddddddkke | 85 | 17928 | 2059 |
| 542050 | n/a | Intron 1 | TCTTTCATGAATCAAG | eekddddddddddkke | 54 | 17929 | 2060 |
| 542051 | n/a | Intron 1 | GTCTTTCATGAATCAA | eekddddddddddkke | 96 | 17930 | 2061 |
| 542052 | n/a | Intron 1 | GGTCTTTCATGAATCA | eekddddddddddkke | 98 | 17931 | 2062 |
| 542053 | n/a | Intron 1 | ATGGTCTTTCATGAAT | eekddddddddddkke | 94 | 17933 | 2063 |
| 542054 | n/a | Intron 1 | GATGGTCTTTCATGAA | eekddddddddddkke | 73 | 17934 | 2064 |
| 542055 | n/a | Intron 1 | TGATGGTCTTTCATGA | eekddddddddddkke | 83 | 17935 | 2065 |
| 542056 | n/a | Intron 1 | TATATCAATATTCTCC | eekddddddddddkke | 75 | 21821 | 2066 |
| 542057 | n/a | Intron 1 | TTATATCAATATTCTC | eekddddddddddkke | 23 | 21822 | 2067 |
| 542058 | n/a | Intron 1 | GTTATATCAATATTCT | eekddddddddddkke | 87 | 21823 | 2068 |
| 542059 | n/a | Intron 1 | TTTCTTTAGCAATAGT | eekddddddddddkke | 85 | 22519 | 2069 |
| 542060 | n/a | Intron 1 | CTTTCTTTAGCAATAG | eekddddddddddkke | 81 | 22520 | 2070 |
| 542061 | n/a | Intron 1 | GCTTTCTTTAGCAATA | eekddddddddddkke | 68 | 22521 | 2071 |
| 542062 | n/a | Intron 1 | CTCCATTAGGGTTCTG | eekddddddddddkke | 91 | 50948 | 2072 |
| 542063 | n/a | Intron 1 | TCTCCATTAGGGTTCT | eekddddddddddkke | 88 | 50949 | 2073 |
| 542064 | n/a | Intron 1 | TTCTCCATTAGGGTTC | eekddddddddddkke | 85 | 50950 | 2074 |
| 542065 | n/a | Intron 1 | GTTCTCCATTAGGGTT | eekddddddddddkke | 84 | 50951 | 2075 |
| 542066 | n/a | Intron 1 | AGGTTGGCAGACAGAC | eekddddddddddkke | 92 | 53467 | 2076 |
| 542067 | n/a | Intron 1 | CAGGTTGGCAGACAGA | eekddddddddddkke | 93 | 53468 | 2077 |
| 542068 | n/a | Intron 1 | GCAGGTTGGCAGACAG | eekddddddddddkke | 91 | 53469 | 2078 |
| 542069 | n/a | Intron 1 | CTTCTTGTGAGCTGGC | eekddddddddddkke | 95 | 64885 | 2079 |
| 542070 | n/a | Intron 1 | TCTTCTTGTGAGCTGG | eekddddddddddkke | 89 | 64886 | 2080 |

TABLE 183-continued

Inhibition of GHR mRNA by deoxy, MOE and (S)-cEt gapmers targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 542071 | n/a | Intron 1 | GTCTTCTTGTGAGCTG | eekddddddddddkke | 96 | 64887 | 2081 |
| 542072 | n/a | Intron 1 | AGTCTTCTTGTGAGCT | eekddddddddddkke | 81 | 64888 | 2082 |
| 542073 | n/a | Intron 1 | TCTTCCACTCACATCC | eekddddddddddkke | 89 | 65991 | 2083 |
| 542074 | n/a | Intron 1 | CTCTTCCACTCACATC | eekddddddddddkke | 79 | 65992 | 2084 |
| 542075 | n/a | Intron 1 | TCTCTTCCACTCACAT | eekddddddddddkke | 86 | 65993 | 2085 |
| 542076 | n/a | Intron 1 | GTCTCTTCCACTCACA | eekddddddddddkke | 92 | 65994 | 2086 |
| 542077 | n/a | Intron 1 | ATAGATTTTGACTTCC | eekddddddddddkke | 86 | 72108 | 2087 |
| 542078 | n/a | Intron 1 | CATAGATTTTGACTTC | eekddddddddddkke | 42 | 72109 | 2088 |
| 542079 | n/a | Intron 1 | GCATAGATTTTGACTT | eekddddddddddkke | 66 | 72110 | 2089 |
| 542080 | n/a | Intron 1 | AAATGTCAACAGTGCA | eekddddddddddkke | 97 | 80639 | 2090 |
| 542081 | n/a | Intron 1 | CATGACTATGTTCTGG | eekddddddddddkke | 68 | 125595 | 2091 |
| 542082 | n/a | Intron 1 | ACATGACTATGTTCTG | eekddddddddddkke | 66 | 125596 | 2092 |
| 542083 | n/a | Intron 1 | CACATGACTATGTTCT | eekddddddddddkke | 74 | 125597 | 2093 |
| 542084 | n/a | Intron 2 | GAATTCTGAGCTCTGG | eekddddddddddkke | 91 | 145430 | 2094 |
| 542085 | n/a | Intron 2 | TGAATTCTGAGCTCTG | eekddddddddddkke | 94 | 145431 | 2095 |
| 542086 | n/a | Intron 2 | CTGAATTCTGAGCTCT | eekddddddddddkke | 94 | 145432 | 2096 |
| 542087 | n/a | Intron 2 | CCTGAATTCTGAGCTC | eekddddddddddkke | 93 | 145433 | 2097 |
| 542088 | n/a | Intron 2 | GCCTGAATTCTGAGCT | eekddddddddddkke | 87 | 145434 | 2098 |
| 542089 | n/a | Intron 2 | AGCCTGAATTCTGAGC | eekddddddddddkke | 84 | 145435 | 2099 |
| 542090 | n/a | Intron 2 | ATATTGTAATTCTTGG | eekddddddddddkke | 47 | 148060 | 2100 |
| 542091 | n/a | Intron 2 | GATATTGTAATTCTTG | eekddddddddddkke | 61 | 148061 | 2101 |
| 542092 | n/a | Intron 2 | TGATATTGTAATTCTT | eekddddddddddkke | 0 | 148062 | 2102 |
| 542093 | n/a | Intron 2 | CTGATATTGTAATTCT | eekddddddddddkke | 58 | 148063 | 2103 |
| 542094 | n/a | Intron 2 | CCTGATATTGTAATTC | eekddddddddddkke | 95 | 148064 | 2104 |
| 542095 | n/a | Intron 2 | GCCTGATATTGTAATT | eekddddddddddkke | 85 | 148065 | 2105 |
| 542096 | n/a | Intron 2 | TGCCTGATATTGTAAT | eekddddddddddkke | 86 | 148066 | 2106 |
| 542097 | n/a | Intron 2 | ATTATGTGCTTTGCCT | eekddddddddddkke | 86 | 148907 | 2107 |
| 542098 | n/a | Intron 2 | AATTATGTGCTTTGCC | eekddddddddddkke | 75 | 148908 | 2108 |
| 542099 | n/a | Intron 2 | CAATTATGTGCTTTGC | eekddddddddddkke | 88 | 148909 | 2109 |
| 542100 | n/a | Intron 2 | TCAATTATGTGCTTTG | eekddddddddddkke | 78 | 148910 | 2110 |
| 542101 | n/a | Intron 2 | GTCAATTATGTGCTTT | eekddddddddddkke | 97 | 148911 | 2111 |
| 542102 | n/a | Intron 2 | GCCATCACCAAACACC | eekddddddddddkke | 97 | 150973 | 2112 |
| 542103 | n/a | Intron 2 | TGCCATCACCAAACAC | eekddddddddddkke | 90 | 150974 | 2113 |
| 542104 | n/a | Intron 2 | TTGCCATCACCAAACA | eekddddddddddkke | 89 | 150975 | 2114 |
| 542105 | n/a | Intron 2 | TGGTGACTCTGCCTGA | eekddddddddddkke | 98 | 151388 | 2115 |
| 542106 | n/a | Intron 2 | CTGGTGACTCTGCCTG | eekddddddddddkke | 96 | 151389 | 2116 |

TABLE 183-continued

Inhibition of GHR mRNA by deoxy, MOE and (S)-cEt gapmers targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 542107 | n/a | Intron 2 | GCTGGTGACTCTGCCT | eekddddddddddkke | 98 | 151390 | 2117 |
| 542108 | n/a | Intron 2 | TGCTGGTGACTCTGCC | eekddddddddddkke | 97 | 151391 | 2118 |
| 542109 | n/a | Intron 2 | CTGCTGGTGACTCTGC | eekddddddddddkke | 93 | 151392 | 2119 |

TABLE 184

Inhibition of GHR mRNA by deoxy, MOE and (S)-cEt gapmers targeting introns 2 and 3 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 541262 | 156891 | 156906 | Intron 2 | TTGGTTTGTCAATCCT | eekddddddddddkke | 95 | 1370 |
| 542110 | 153002 | 153017 | Intron 2 | AGTAGTCAATATTATT | eekddddddddddkke | 74 | 2120 |
| 542111 | 153003 | 153018 | Intron 2 | CAGTAGTCAATATTAT | eekddddddddddkke | 55 | 2121 |
| 542112 | 153004 | 153019 | Intron 2 | CCAGTAGTCAATATTA | eekddddddddddkke | 97 | 2122 |
| 542113 | 153922 | 153937 | Intron 2 | CCTTTGGGTGAATAGC | eekddddddddddkke | 90 | 2123 |
| 542114 | 153923 | 153938 | Intron 2 | ACCTTTGGGTGAATAG | eekddddddddddkke | 71 | 2124 |
| 542115 | 153924 | 153939 | Intron 2 | CACCTTTGGGTGAATA | eekddddddddddkke | 78 | 2125 |
| 542116 | 155595 | 155610 | Intron 2 | CAACTTGAGGACAATA | eekddddddddddkke | 89 | 2126 |
| 542118 | 155597 | 155612 | Intron 2 | CTCAACTTGAGGACAA | eekddddddddddkke | 98 | 2127 |
| 542119 | 156395 | 156410 | Intron 2 | CAGGAAGAAAGGAACC | eekddddddddddkke | 95 | 2128 |
| 542120 | 156396 | 156411 | Intron 2 | CCAGGAAGAAAGGAAC | eekddddddddddkke | 83 | 2129 |
| 542121 | 156397 | 156412 | Intron 2 | ACCAGGAAGAAAGGAA | eekddddddddddkke | 90 | 2130 |
| 542122 | 156595 | 156610 | Intron 2 | TGCAGTCATGTACACA | eekddddddddddkke | 97 | 2131 |
| 542123 | 156596 | 156611 | Intron 2 | CTGCAGTCATGTACAC | eekddddddddddkke | 90 | 2132 |
| 542124 | 156597 | 156612 | Intron 2 | TCTGCAGTCATGTACA | eekddddddddddkke | 81 | 2133 |
| 542125 | 156890 | 156905 | Intron 2 | TGGTTTGTCAATCCTT | eekddddddddddkke | 97 | 2134 |
| 542126 | 156892 | 156907 | Intron 2 | CTTGGTTTGTCAATCC | eekddddddddddkke | 99 | 2135 |
| 542127 | 157204 | 157219 | Intron 2 | GCTACAATGCACAGGA | eekddddddddddkke | 98 | 2136 |
| 542128 | 157205 | 157220 | Intron 2 | TGCTACAATGCACAGG | eekddddddddddkke | 98 | 2137 |
| 542129 | 158008 | 158023 | Intron 2 | GATATTTATTGCTGTA | eekddddddddddkke | 61 | 2138 |
| 542130 | 158009 | 158024 | Intron 2 | TGATATTTATTGCTGT | eekddddddddddkke | 41 | 2139 |
| 542131 | 158010 | 158025 | Intron 2 | CTGATATTTATTGCTG | eekddddddddddkke | 86 | 2140 |
| 542132 | 162752 | 162767 | Intron 2 | AGGGTCTTTACAAAGT | eekddddddddddkke | 69 | 2141 |
| 542133 | 162753 | 162768 | Intron 2 | CAGGGTCTTTACAAAG | eekddddddddddkke | 71 | 2142 |
| 542134 | 162754 | 162769 | Intron 2 | CCAGGGTCTTTACAAA | eekddddddddddkke | 93 | 2143 |

TABLE 184-continued

Inhibition of GHR mRNA by deoxy, MOE and (S)-cEt gapmers targeting introns 2 and 3 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 542135 | 166353 | 166368 | Intron 2 | TTCTGCAGTATCCTAG | eekdddddddddddkke | 84 | 2144 |
| 542136 | 166354 | 166369 | Intron 2 | TTTCTGCAGTATCCTA | eekdddddddddddkke | 88 | 2145 |
| 542137 | 166355 | 166370 | Intron 2 | GTTTCTGCAGTATCCT | eekdddddddddddkke | 95 | 2146 |
| 542138 | 166356 | 166371 | Intron 2 | AGTTTCTGCAGTATCC | eekdddddddddddkke | 92 | 2147 |
| 542139 | 166357 | 166372 | Intron 2 | CAGTTTCTGCAGTATC | eekdddddddddddkke | 93 | 2148 |
| 542140 | 172747 | 172762 | Intron 2 | CAAATTCCAGTCCTAG | eekdddddddddddkke | 73 | 2149 |
| 542141 | 172748 | 172763 | Intron 2 | CCAAATTCCAGTCCTA | eekdddddddddddkke | 91 | 2150 |
| 542142 | 172749 | 172764 | Intron 2 | TCCAAATTCCAGTCCT | eekdddddddddddkke | 90 | 2151 |
| 542143 | 175372 | 175387 | Intron 2 | ACCCATTTCATCCATT | eekdddddddddddkke | 94 | 2152 |
| 542144 | 175373 | 175388 | Intron 2 | AACCCATTTCATCCAT | eekdddddddddddkke | 93 | 2153 |
| 542145 | 175374 | 175389 | Intron 2 | GAACCCATTTCATCCA | eekdddddddddddkke | 97 | 2154 |
| 542146 | 175375 | 175390 | Intron 2 | GGAACCCATTTCATCC | eekdddddddddddkke | 96 | 2155 |
| 542147 | 175376 | 175391 | Intron 2 | AGGAACCCATTTCATC | eekdddddddddddkke | 68 | 2156 |
| 542148 | 189120 | 189135 | Intron 2 | GCTTCATGTCTTTCTA | eekdddddddddddkke | 90 | 2157 |
| 542149 | 189121 | 189136 | Intron 2 | TGCTTCATGTCTTTCT | eekdddddddddddkke | 96 | 2158 |
| 542150 | 189122 | 189137 | Intron 2 | GTGCTTCATGTCTTTC | eekdddddddddddkke | 97 | 2159 |
| 542151 | 189485 | 189500 | Intron 2 | TGAGCTTAGCAGTCAC | eekdddddddddddkke | 92 | 2160 |
| 542152 | 189486 | 189501 | Intron 2 | ATGAGCTTAGCAGTCA | eekdddddddddddkke | 95 | 2161 |
| 542153 | 189487 | 189502 | Intron 2 | CATGAGCTTAGCAGTC | eekdddddddddddkke | 95 | 2162 |
| 542154 | 191143 | 191158 | Intron 2 | TACAGACATAGCTCTA | eekdddddddddddkke | 91 | 2163 |
| 542155 | 191144 | 191159 | Intron 2 | ATACAGACATAGCTCT | eekdddddddddddkke | 74 | 2164 |
| 542156 | 191145 | 191160 | Intron 2 | GATACAGACATAGCTC | eekdddddddddddkke | 91 | 2165 |
| 542157 | 191146 | 191161 | Intron 2 | GGATACAGACATAGCT | eekdddddddddddkke | 94 | 2166 |
| 542158 | 198149 | 198164 | Intron 2 | TGTGGCTTTAATTCAC | eekdddddddddddkke | 71 | 2167 |
| 542159 | 198150 | 198165 | Intron 2 | ATGTGGCTTTAATTCA | eekdddddddddddkke | 81 | 2168 |
| 542160 | 198151 | 198166 | Intron 2 | TATGTGGCTTTAATTC | eekdddddddddddkke | 78 | 2169 |
| 542161 | 199817 | 199832 | Intron 2 | TGTTCAGTTGCATCAC | eekdddddddddddkke | 91 | 2170 |
| 542162 | 199818 | 199833 | Intron 2 | GTGTTCAGTTGCATCA | eekdddddddddddkke | 89 | 2171 |
| 542163 | 199819 | 199834 | Intron 2 | TGTGTTCAGTTGCATC | eekdddddddddddkke | 90 | 2172 |
| 542164 | 210562 | 210577 | Intron 3 | CATCTGGATGTGAGGC | eekdddddddddddkke | 90 | 2173 |
| 542165 | 210563 | 210578 | Intron 3 | ACATCTGGATGTGAGG | eekdddddddddddkke | 78 | 2174 |
| 542166 | 210564 | 210579 | Intron 3 | CACATCTGGATGTGAG | eekdddddddddddkke | 55 | 2175 |
| 542167 | 219020 | 219035 | Intron 3 | TCAGGTAATTTCTGGA | eekdddddddddddkke | 82 | 2176 |
| 542168 | 219021 | 219036 | Intron 3 | CTCAGGTAATTTCTGG | eekdddddddddddkke | 73 | 2177 |
| 542169 | 219022 | 219037 | Intron 3 | TCTCAGGTAATTTCTG | eekdddddddddddkke | 40 | 2178 |
| 542170 | 225568 | 225583 | Intron 3 | TGCTTATTTACCTGGG | eekdddddddddddkke | 90 | 2179 |

TABLE 184-continued

Inhibition of GHR mRNA by deoxy, MOE and (S)-cEt
gapmers targeting introns 2 and 3 of SEQ ID NO: 2

| ISIS NO | SEQ ID NO: 2 Start Site | SEQ ID NO: 2 Stop Site | Target Region | Sequence | Chemistry | % inhibition | SEQ ID NO |
|---|---|---|---|---|---|---|---|
| 542171 | 225569 | 225584 | Intron 3 | TTGCTTATTTACCTGG | eekddddddddddkke | 90 | 2180 |
| 542172 | 225570 | 225585 | Intron 3 | TTTGCTTATTTACCTG | eekddddddddddkke | 79 | 2181 |
| 542173 | 225571 | 225586 | Intron 3 | TTTTGCTTATTTACCT | eekddddddddddkke | 32 | 2182 |
| 542174 | 229619 | 229634 | Intron 3 | ATGATGTTACTACTAC | eekddddddddddkke | 63 | 2183 |
| 542175 | 229620 | 229635 | Intron 3 | AATGATGTTACTACTA | eekddddddddddkke | 53 | 2184 |
| 542176 | 229621 | 229636 | Intron 3 | CAATGATGTTACTACT | eekddddddddddkke | 12 | 2185 |
| 542177 | 232827 | 232842 | Intron 3 | CCCCTAGAGCAATGGT | eekddddddddddkke | 76 | 2186 |
| 542178 | 232828 | 232843 | Intron 3 | CCCCCTAGAGCAATGG | eekddddddddddkke | 83 | 2187 |
| 542179 | 232829 | 232844 | Intron 3 | TCCCCCTAGAGCAATG | eekddddddddddkke | 49 | 2188 |
| 542180 | 237676 | 237691 | Intron 3 | TCAATTGCAGATGCTC | eekddddddddddkke | 88 | 2189 |
| 542181 | 237677 | 237692 | Intron 3 | CTCAATTGCAGATGCT | eekddddddddddkke | 90 | 2190 |
| 542182 | 237678 | 237693 | Intron 3 | GCTCAATTGCAGATGC | eekddddddddddkke | 81 | 2191 |
| 542183 | 237679 | 237694 | Intron 3 | AGCTCAATTGCAGATG | eekddddddddddkke | 85 | 2192 |
| 542184 | 248232 | 248247 | Intron 3 | GTATATTCAGTCCAAG | eekddddddddddkke | 90 | 2193 |
| 542185 | 248233 | 248248 | Intron 3 | AGTATATTCAGTCCAA | eekddddddddddkke | 94 | 2194 |
| 542186 | 248234 | 248249 | Intron 3 | CAGTATATTCAGTCCA | eekddddddddddkke | 97 | 2195 |

TABLE 185

Inhibition of GHR mRNA by deoxy, MOE and (S)-cEt gapmers
targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541262 | n/a | Intron 2 | TTGGTTTGTCAATCCT | eekddddddddddkke | 93 | 156891 | 1370 |
| 545316 | 168 | exon 1-intron 1 junction | ACCTCCGAGCTTCGCC | eekddddddddddkke | 80 | 3044 | 2196 |
| 545317 | 173 | exon-exon junction | GTAGGACCTCCGAGCT | eekddddddddddkke | 74 | n/a | 2197 |
| 545318 | 177 | exon-exon junction | ACCTGTAGGACCTCCG | eekddddddddddkke | 70 | n/a | 2198 |
| 545321 | 213 | Exon 2 | CAGTGCCAAGGTCAAC | eekddddddddddkke | 77 | 144997 | 2199 |
| 545322 | 225 | Exon 2 | ACTTGATCCTGCCAGT | eekddddddddddkke | 36 | 145009 | 2200 |
| 545332 | 361 | Exon 4/Intron 3 | CTCGCTCAGGTGAACG | eekddddddddddkke | 57 | 268024 | 2201 |
| 545333 | 366 | Exon 4/Intron 3 | AGTCTCTCGCTCAGGT | eekddddddddddkke | 88 | 268029 | 2202 |
| 545337 | 444 | Exon 4-intron 4 junction | CCTTCTGGTATAGAAC | eekddddddddddkke | 21 | 268107 | 2203 |
| 545340 | 570 | Exon 5 | GCTAGTTAGCTTGATA | eekddddddddddkke | 39 | 274130 | 2204 |

TABLE 185-continued

Inhibition of GHR mRNA by deoxy, MOE and (S)-cEt gapmers targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 545343 | 626 | exon 3-exon 4 junction | TCTGGTTGCACTATTT | eekddddddddddkke | 34 | n/a | 2205 |
| 545344 | 629 | exon 3-exon 4 junction | GGATCTGGTTGCACTA | eekddddddddddkke | 30 | n/a | 2206 |
| 545345 | 632 | Exon 6 | GGTGGATCTGGTTGCA | eekddddddddddkke | 18 | 278926 | 2207 |
| 545346 | 638 | Exon 6 | GCAATGGGTGGATCTG | eekddddddddddkke | 50 | 278932 | 2208 |
| 545347 | 647 | Exon 6 | CAGTTGAGGGCAATGG | eekddddddddddkke | 71 | 278941 | 2209 |
| 545348 | 651 | Exon 6 | AGTCCAGTTGAGGGCA | eekddddddddddkke | 58 | 278945 | 2210 |
| 545349 | 655 | Exon 6 | GTAAAGTCCAGTTGAG | eekddddddddddkke | 34 | 278949 | 2211 |
| 545350 | 660 | Exon 6 | GTTCAGTAAAGTCCAG | eekddddddddddkke | 52 | 278954 | 2212 |
| 545351 | 685 | Exon 6 | CTGCATGAATCCCAGT | eekddddddddddkke | 77 | 278979 | 2213 |
| 545355 | 923 | Exon 7 | ACATAGAGCACCTCAC | eekddddddddddkke | 38 | 290421 | 2214 |
| 545356 | 926 | Exon 7 | GTTACATAGAGCACCT | eekddddddddddkke | 79 | 290424 | 2215 |
| 545357 | 929 | Exon 7 | AGTGTTACATAGAGCA | eekddddddddddkke | 70 | 290427 | 2216 |
| 545362 | 1124 | Exon 7-exon 8 junction | TCCTTGAGGAGATCTG | eekddddddddddkke | 3 | n/a | 2217 |
| 545363 | 1170 | Exon 10 | GCTATCATGAATGGCT | eekddddddddddkke | 69 | 297587 | 2218 |
| 545364 | 1180 | Exon 10 | CGGGTTTATAGCTATC | eekddddddddddkke | 58 | 297597 | 2219 |
| 545369 | 1320 | Exon 10 | ATCCTTCACCCCTAGG | eekddddddddddkke | 46 | 297737 | 2220 |
| 545370 | 1328 | Exon 10 | GAGTCGCCATCCTTCA | eekddddddddddkke | 60 | 297745 | 2221 |
| 545371 | 1332 | Exon 10 | TCCAGAGTCGCCATCC | eekddddddddddkke | 51 | 297749 | 2222 |
| 545373 | 1418 | Exon 10 | GGCTGAGCAACCTCTG | eekddddddddddkke | 80 | 297835 | 2223 |
| 545374 | 1422 | Exon 10 | CTGTGGCTGAGCAACC | eekddddddddddkke | 63 | 297839 | 2224 |
| 545380 | 1524 | Exon 10 | GATAACACTGGGCTGC | eekddddddddddkke | 60 | 297941 | 2225 |
| 545381 | 1530 | Exon 10 | TGCTTGGATAACACTG | eekddddddddddkke | 76 | 297947 | 2226 |
| 545382 | 1533 | Exon 10 | CTCTGCTTGGATAACA | eekddddddddddkke | 60 | 297950 | 2227 |
| 545386 | 1600 | Exon 10 | GCTGAATATGGGCAGC | eekddddddddddkke | 29 | 298017 | 2228 |
| 545387 | 1613 | Exon 10 | CTTGGATTGCTTAGCT | eekddddddddddkke | 59 | 298030 | 2229 |
| 545388 | 1645 | Exon 10 | CCTGGGCATAAAAGTC | eekddddddddddkke | 47 | 298062 | 2230 |
| 545392 | 1832 | Exon 10 | ACCTTGATGTGAGGAG | eekddddddddddkke | 44 | 298249 | 2231 |

TABLE 186

Inhibition of GHR mRNA by deoxy, MOE and (S)-cEt gapmers targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 541262 | n/a | Intron 2 | TTGGTTTGTCAATCCT | eekddddddddddkke | 89 | 156891 | 1370 |
| 545393 | 1838 | Exon 10 | GATTCAACCTTGATGT | eekddddddddddkke | 40 | 298255 | 2232 |
| 545394 | 1844 | Exon 10 | ATGTGTGATTCAACCT | eekddddddddddkke | 80 | 298261 | 2233 |
| 545395 | 1956 | Exon 10 | TGGGACAGGCATCTCA | eekddddddddddkke | 29 | 298373 | 2234 |
| 545396 | 1961 | Exon 10 | TAGTCTGGGACAGGCA | eekddddddddddkke | 48 | 298378 | 2235 |
| 545397 | 1968 | Exon 10 | GGAGGTATAGTCTGGG | eekddddddddddkke | 61 | 298385 | 2236 |
| 545398 | 1986 | Exon 10 | GGACTGTACTATATGA | eekddddddddddkke | 48 | 298403 | 2237 |
| 545401 | 2077 | Exon 10 | TCAGTTGGTCTGTGCT | eekddddddddddkke | 60 | 298494 | 2238 |
| 545402 | 2095 | Exon 10 | GCTAAGGCATGATTTT | eekddddddddddkke | 53 | 298512 | 2239 |
| 545406 | 2665 | Exon 10 | GCCATGCTTGAAGTCT | eekddddddddddkke | 87 | 299082 | 2240 |
| 545407 | 2668 | Exon 10 | ATAGCCATGCTTGAAG | eekddddddddddkke | 70 | 299085 | 2241 |
| 545408 | 2692 | Exon 10 | ACACAGTGTGTAGTGT | eekddddddddddkke | 60 | 299109 | 2242 |
| 545409 | 2699 | Exon 10 | CTGCAGTACACAGTGT | eekddddddddddkke | 31 | 299116 | 2243 |
| 545410 | 2704 | Exon 10 | ACCAACTGCAGTACAC | eekddddddddddkke | 57 | 299121 | 2244 |
| 545411 | 2739 | Exon 10 | TAGACTGTAGTTGCTA | eekddddddddddkke | 53 | 299156 | 2245 |
| 545412 | 2747 | Exon 10 | ACCAGCTTTAGACTGT | eekddddddddddkke | 56 | 299164 | 2246 |
| 545413 | 2945 | Exon 10 | GTAAGTTGATCTGTGC | eekddddddddddkke | 79 | 299362 | 2247 |
| 545414 | 2963 | Exon 10 | TACTTCTTTTGGTGCC | eekddddddddddkke | 82 | 299380 | 2248 |
| 545416 | 3212 | Exon 10 | TCTTGTACCTTATTCC | eekddddddddddkke | 73 | 299629 | 2249 |
| 545417 | 3306 | Exon 10 | TGGTTATAGGCTGTGA | eekddddddddddkke | 90 | 299723 | 2250 |
| 545418 | 3309 | Exon 10 | GTCTGGTTATAGGCTG | eekddddddddddkke | 88 | 299726 | 2251 |
| 545419 | 3313 | Exon 10 | ATGTGTCTGGTTATAG | eekddddddddddkke | 68 | 299730 | 2252 |
| 545420 | 3317 | Exon 10 | GAGTATGTGTCTGGTT | eekddddddddddkke | 84 | 299734 | 2253 |
| 545421 | 4049 | Exon 10 | GGTCTGCGATAAATGG | eekddddddddddkke | 69 | 300466 | 2254 |
| 545429 | 4424 | Exon 10 | GCCAGACACAACTAGT | eekddddddddddkke | 59 | 300841 | 2255 |
| 545430 | 31 | Exon 1 | ACCGCCACTGTAGCAG | eekddddddddddkke | 76 | 2907 | 2256 |
| 545431 | 36 | Exon 1 | CCGCCACCGCCACTGT | eekddddddddddkke | 94 | 2912 | 2257 |
| 545432 | 103 | Exon 1 | GGGCCTCCGGCCCGCG | eekddddddddddkke | 22 | 2979 | 2258 |
| 545433 | 143 | Exon 1 | AGAGCGCGGGTTCGCG | eekddddddddddkke | 61 | 3019 | 2259 |
| 545434 | n/a | Intron 1/Exon 1 | TACTGACCCCAGTTCC | eekddddddddddkke | 68 | 3654 | 2260 |
| 545435 | n/a | Intron 1/Exon 1 | ACTCTACTGACCCCAG | eekddddddddddkke | 70 | 3658 | 2261 |
| 545436 | n/a | Intron 1/Exon 1 | GTCACTCTACTGACCC | eekddddddddddkke | 83 | 3661 | 2262 |
| 545437 | n/a | Intron 1/Exon 1 | TTCATGCGGACTGGTG | eekddddddddddkke | 68 | 3680 | 2263 |

TABLE 186-continued

Inhibition of GHR mRNA by deoxy, MOE and (S)-cEt gapmers targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 545438 | n/a | Intron 3/Exon 3 | GTGAGCATGGACCCCA | eekddddddddddkke | 94 | 225436 | 2264 |
| 545439 | n/a | Intron 3/Exon 3 | TGATATGTGAGCATGG | eekddddddddddkke | 88 | 225442 | 2265 |
| 545440 | n/a | Intron 3/Exon 3 | AAGTTGGTGAGCTTCT | eekddddddddddkke | 85 | 226785 | 2266 |
| 545441 | n/a | Intron 3/Exon 3 | CCTTCAAGTTGGTGAG | eekddddddddddkke | 88 | 226790 | 2267 |
| 545442 | n/a | Intron 3/Exon 3 | GTAAGATCCTTTTGCC | eekddddddddddkke | 70 | 226883 | 2268 |
| 545443 | n/a | Intron 3/Exon 3 | CAGCTGTGCAACTTGC | eekddddddddddkke | 50 | 238345 | 2269 |
| 545444 | n/a | Intron 3/Exon 3 | GCCTTGGTAGGTAGGG | eekddddddddddkke | 68 | 238422 | 2270 |
| 545445 | n/a | Intron 3/Exon 3 | AGAGCCTTGGTAGGTA | eekddddddddddkke | 85 | 238425 | 2271 |
| 545446 | n/a | Intron 1/Exon 1 | CCCGCACAAACGCGCA | eekddddddddddkke | 10 | 3614 | 2272 |
| 545447 | n/a | Intron 1/Exon 1 | GTCTTCAAGGTCAGTT | eekddddddddddkke | 92 | 93208 | 2273 |
| 545448 | n/a | Intron 1/Exon 1 | GCCCAGTGAATTCAGC | eekddddddddddkke | 76 | 93246 | 2274 |
| 545449 | n/a | Intron 1/Exon 1 | AGATGCGCCCAGTGAA | eekddddddddddkke | 60 | 93252 | 2275 |
| 545450 | n/a | Intron 1/Exon 1 | GTAAGATGCGCCCAGT | eekddddddddddkke | 78 | 93255 | 2276 |
| 545451 | n/a | Intron 1/Exon 1 | CCAGAAGGCACTTGTA | eekddddddddddkke | 42 | 93301 | 2277 |
| 545452 | n/a | Intron 1/Exon 1 | GGAAGATTTGCAGAAC | eekddddddddddkke | 15 | 93340 | 2278 |
| 545453 | n/a | Intron 1/Exon 1 | CCTTGGTCATGGAAGA | eekddddddddddkke | 35 | 93350 | 2279 |
| 545454 | n/a | Intron 1/Exon 1 | TGACCTTGGTCATGGA | eekddddddddddkke | 55 | 93353 | 2280 |
| 545455 | n/a | Intron 1/Exon 1 | GAGGTGACCTTGGTCA | eekddddddddddkke | 70 | 93357 | 2281 |
| 545456 | n/a | Intron 1/Exon 1 | ATCCAAAGAGGTGACC | eekddddddddddkke | 41 | 93364 | 2282 |
| 545457 | n/a | Intron 1/Exon 1 | GCCAATCCAAAGAGGT | eekddddddddddkke | 56 | 93368 | 2283 |
| 545458 | n/a | Intron 1/Exon 1 | GGTCTGCCAATCCAAA | eekddddddddddkke | 79 | 93373 | 2284 |
| 545459 | n/a | Intron 1/Exon 1 | CCCTGGGTCTGCCAAT | eekddddddddddkke | 68 | 93378 | 2285 |
| 545460 | n/a | Intron 1/Exon 1 | GAGATCTCAACAAGGG | eekddddddddddkke | 52 | 93427 | 2286 |
| 545461 | n/a | Intron 1/Exon 1 | CGCCCATCACTCTTCC | eekddddddddddkke | 68 | 93988 | 2287 |

TABLE 186-continued

Inhibition of GHR mRNA by deoxy, MOE and (S)-cEt gapmers targeting intronic and exonic regions of SEQ ID NOs: 1 and 2

| ISIS NO | SEQ ID NO: 1 Start Site | Target Region | Sequence | Chemistry | % inhibition | SEQ ID NO: 2 Start Site | SEQ ID NO |
|---|---|---|---|---|---|---|---|
| 545462 | n/a | Intron 1/Exon 1 | CACCTGTCGCCCATCA | eekddddddddddkke | 67 | 93995 | 2288 |
| 545463 | n/a | Intron 1/Exon 1 | CATCACCTGTCGCCCA | eekddddddddddkke | 78 | 93998 | 2289 |
| 545464 | n/a | Intron 1/Exon 1 | CACCATCACCTGTCGC | eekddddddddddkke | 74 | 94001 | 2290 |
| 545465 | n/a | Intron 1/Exon 1 | AATAGTTGTCACCATC | eekddddddddddkke | 76 | 94010 | 2291 |
| 545466 | n/a | Intron 1/Exon 1 | GCCACCTTTCATGAGA | eekddddddddddkke | 58 | 94048 | 2292 |
| 545467 | n/a | Intron 2/Exon 2 | CTCTTGGAAGTAGGTA | eekddddddddddkke | 89 | 198762 | 2293 |
| 545468 | n/a | Intron 2/Exon 2 | GTTCTCTTGGAAGTAG | eekddddddddddkke | 80 | 198765 | 2294 |
| 545469 | n/a | Intron 2/Exon 2 | TAAACAGGTTGGTCTG | eekddddddddddkke | 68 | 198854 | 2295 |

Example 121

Dose-Dependent Antisense Inhibition of Human GHR in Hep3B Cells by Deoxy, MOE and (S)-cEt Gapmers Gapmers from studies described above exhibiting significant in vitro inhibition of GHR mRNA were selected and tested at various doses in Hep3B cells. The antisense oligonucleotides were tested in a series of experiments that had similar culture conditions. The results for each experiment are presented in separate tables shown below. Cells were plated at a density of 20,000 cells per well and transfected using electroporation with 0.625 µM, 1.25 µM, 2.50 µM, 5.00 µM and 10.00 µM concentrations of antisense oligonucleotide. After a treatment period of approximately 16 hours, RNA was isolated from the cells and GHR mRNA levels were measured by quantitative real-time PCR. Human primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration ($IC_{50}$) of each oligonucleotide is also presented. GHR mRNA levels were significantly reduced in a dose-dependent manner in antisense oligonucleotide treated cells.

TABLE 187

| ISIS No | 0.625 µM | 1.250 µM | 2.50 µM | 5.00 µM | 10.00 µM | $IC_{50}$ (µM) |
|---|---|---|---|---|---|---|
| 541396 | 30 | 51 | 68 | 74 | 67 | 1.4 |
| 541262 | 55 | 87 | 90 | 94 | 97 | 0.2 |
| 541393 | 30 | 38 | 52 | 66 | 81 | 2.1 |
| 541375 | 41 | 45 | 54 | 64 | 79 | 1.6 |

TABLE 187-continued

| ISIS No | 0.625 µM | 1.250 µM | 2.50 µM | 5.00 µM | 10.00 µM | $IC_{50}$ (µM) |
|---|---|---|---|---|---|---|
| 541438 | 44 | 49 | 75 | 80 | 91 | 0.9 |
| 541428 | 35 | 32 | 56 | 78 | 88 | 1.8 |
| 541491 | 13 | 46 | 67 | 55 | 95 | 2.0 |
| 541435 | 21 | 46 | 55 | 72 | 94 | 1.9 |
| 541471 | 11 | 49 | 50 | 77 | 89 | 2.0 |
| 541430 | 24 | 44 | 56 | 57 | 79 | 2.2 |
| 541492 | 32 | 40 | 65 | 80 | 85 | 1.5 |
| 541431 | 22 | 46 | 73 | 84 | 92 | 1.5 |

TABLE 188

| ISIS No | 0.625 µM | 1.250 µM | 2.50 µM | 5.00 µM | 10.00 µM | $IC_{50}$ (µM) |
|---|---|---|---|---|---|---|
| 541487 | 36 | 46 | 66 | 85 | 92 | 1.3 |
| 541423 | 33 | 55 | 64 | 80 | 93 | 1.2 |
| 541452 | 37 | 60 | 79 | 87 | 94 | 0.9 |
| 541505 | 51 | 75 | 86 | 92 | 97 | 0.4 |
| 541522 | 54 | 76 | 81 | 90 | 95 | 0.3 |
| 541539 | 65 | 76 | 85 | 94 | 98 | 0.2 |
| 541503 | 54 | 65 | 80 | 93 | 97 | 0.5 |
| 541520 | 43 | 61 | 86 | 94 | 96 | 0.7 |
| 541515 | 57 | 72 | 85 | 92 | 94 | 0.3 |
| 541564 | 57 | 72 | 88 | 90 | 97 | 0.3 |
| 541554 | 43 | 65 | 81 | 89 | 93 | 0.7 |
| 541509 | 11 | 8 | 19 | 6 | 8 | >10 |
| 541584 | 59 | 65 | 84 | 91 | 96 | 0.3 |
| 541585 | 70 | 80 | 93 | 92 | 98 | 0.1 |

TABLE 189

| ISIS No | 0.625 µM | 1.250 µM | 2.50 µM | 5.00 µM | 10.00 µM | IC$_{50}$ (µM) |
|---|---|---|---|---|---|---|
| 541598 | 26 | 43 | 75 | 80 | 76 | 1.5 |
| 541592 | 35 | 48 | 67 | 85 | 95 | 1.2 |
| 541641 | 22 | 63 | 70 | 91 | 93 | 1.2 |
| 541590 | 27 | 59 | 70 | 94 | 95 | 1.2 |
| 541615 | 40 | 65 | 84 | 88 | 94 | 0.7 |
| 541595 | 35 | 57 | 73 | 84 | 95 | 1.0 |
| 541575 | 49 | 60 | 79 | 84 | 95 | 0.6 |
| 541571 | 41 | 50 | 76 | 80 | 94 | 1.0 |
| 541582 | 0 | 10 | 25 | 50 | 82 | 4.4 |
| 541262 | 66 | 79 | 93 | 94 | 99 | <0.6 |
| 541652 | 1 | 44 | 80 | 82 | 87 | 1.9 |
| 541670 | 29 | 40 | 63 | 79 | 89 | 1.6 |
| 541662 | 17 | 13 | 45 | 62 | 84 | 3.1 |
| 541724 | 37 | 47 | 72 | 85 | 95 | 1.2 |

TABLE 190

| ISIS No | 0.625 µM | 1.250 µM | 2.50 µM | 5.00 µM | 10.00 µM | IC$_{50}$ (µM) |
|---|---|---|---|---|---|---|
| 541748 | 86 | 94 | 96 | 98 | 98 | <0.6 |
| 541767 | 83 | 91 | 95 | 96 | 98 | <0.6 |
| 541797 | 78 | 89 | 93 | 97 | 99 | <0.6 |
| 541766 | 59 | 82 | 92 | 97 | 99 | <0.6 |
| 541742 | 65 | 87 | 93 | 95 | 99 | <0.6 |
| 541750 | 80 | 86 | 96 | 96 | 99 | <0.6 |
| 541262 | 79 | 88 | 93 | 97 | 97 | <0.6 |
| 541749 | 71 | 84 | 93 | 95 | 98 | <0.6 |
| 541793 | 71 | 88 | 94 | 97 | 98 | <0.6 |
| 541785 | 56 | 79 | 89 | 93 | 98 | <0.6 |
| 541746 | 34 | 61 | 85 | 94 | 97 | 0.9 |
| 541752 | 49 | 72 | 88 | 93 | 93 | <0.6 |
| 541826 | 86 | 94 | 95 | 99 | 98 | <0.6 |
| 541811 | 66 | 87 | 93 | 97 | 98 | <0.6 |

TABLE 191

| ISIS No | 0.625 µM | 1.250 µM | 2.50 µM | 5.00 µM | 10.00 µM | IC$_{50}$ (µM) |
|---|---|---|---|---|---|---|
| 541822 | 83 | 88 | 95 | 96 | 96 | <0.6 |
| 541870 | 77 | 87 | 95 | 97 | 98 | <0.6 |
| 541262 | 85 | 93 | 96 | 97 | 98 | <0.6 |
| 541873 | 32 | 77 | 93 | 94 | 97 | 0.7 |
| 541819 | 60 | 91 | 97 | 97 | 99 | <0.6 |
| 541841 | 86 | 91 | 95 | 96 | 97 | <0.6 |
| 541825 | 78 | 88 | 95 | 98 | 98 | <0.6 |
| 541863 | 63 | 77 | 87 | 93 | 97 | <0.6 |
| 541827 | 42 | 80 | 87 | 94 | 97 | <0.6 |
| 541875 | 77 | 84 | 93 | 96 | 97 | <0.6 |
| 541835 | 56 | 73 | 90 | 95 | 98 | <0.6 |
| 541838 | 72 | 90 | 93 | 98 | 97 | <0.6 |
| 541833 | 52 | 69 | 83 | 92 | 97 | <0.6 |
| 541813 | 47 | 75 | 86 | 95 | 97 | <0.6 |

TABLE 192

| ISIS No | 0.625 µM | 1.250 µM | 2.50 µM | 5.00 µM | 10.00 µM | IC$_{50}$ (µM) |
|---|---|---|---|---|---|---|
| 541853 | 74 | 79 | 88 | 93 | 91 | <0.6 |
| 541842 | 69 | 85 | 91 | 97 | 99 | <0.6 |
| 541877 | 79 | 91 | 93 | 98 | 97 | <0.6 |
| 541848 | 58 | 90 | 96 | 98 | 98 | 0.7 |
| 541804 | 23 | 81 | 89 | 95 | 95 | 0.8 |
| 541881 | 87 | 94 | 98 | 98 | 99 | <0.6 |
| 541936 | 91 | 96 | 98 | 99 | 98 | <0.6 |
| 541909 | 56 | 80 | 89 | 95 | 97 | <0.6 |
| 541907 | 75 | 91 | 95 | 97 | 98 | <0.6 |
| 541952 | 68 | 81 | 93 | 97 | 98 | <0.6 |
| 541953 | 68 | 80 | 94 | 97 | 98 | <0.6 |
| 541914 | 60 | 78 | 94 | 97 | 97 | <0.6 |
| 541880 | 56 | 74 | 89 | 94 | 95 | <0.6 |
| 541903 | 37 | 74 | 87 | 96 | 98 | 0.6 |

TABLE 193

| ISIS No | 0.625 µM | 1.250 µM | 2.50 µM | 5.00 µM | 10.00 µM | IC$_{50}$ (µM) |
|---|---|---|---|---|---|---|
| 541895 | 47 | 72 | 85 | 93 | 94 | <0.6 |
| 541882 | 60 | 67 | 89 | 93 | 97 | <0.6 |
| 541889 | 63 | 80 | 87 | 94 | 97 | <0.6 |
| 541904 | 26 | 78 | 23 | 89 | 93 | 1.4 |
| 545418 | 0 | 81 | 91 | 94 | 95 | 1.7 |
| 541930 | 58 | 71 | 82 | 88 | 92 | <0.6 |
| 545439 | 67 | 87 | 93 | 96 | 98 | <0.6 |
| 542024 | 15 | 58 | 78 | 87 | 90 | 1.4 |
| 541985 | 59 | 81 | 88 | 93 | 97 | <0.6 |
| 541972 | 47 | 58 | 83 | 90 | 92 | 0.6 |
| 541991 | 57 | 64 | 88 | 92 | 83 | <0.6 |
| 541980 | 33 | 50 | 76 | 72 | 93 | 1.2 |

TABLE 194

| ISIS No | 0.625 µM | 1.250 µM | 2.50 µM | 5.00 µM | 10.00 µM | IC$_{50}$ (µM) |
|---|---|---|---|---|---|---|
| 541264 | 26 | 44 | 64 | 79 | 89 | 1.6 |
| 541265 | 29 | 32 | 62 | 79 | 91 | 1.8 |
| 541263 | 25 | 40 | 62 | 78 | 93 | 1.7 |
| 541268 | 57 | 73 | 85 | 90 | 95 | 0.3 |
| 541266 | 15 | 33 | 46 | 66 | 90 | 2.5 |
| 542107 | 93 | 97 | 98 | 98 | 98 | <0.6 |
| 542052 | 93 | 96 | 97 | 96 | 98 | <0.6 |
| 542105 | 80 | 92 | 96 | 98 | 97 | <0.6 |
| 542102 | 94 | 96 | 96 | 97 | 98 | <0.6 |
| 542108 | 90 | 92 | 94 | 97 | 99 | <0.6 |
| 542080 | 87 | 93 | 95 | 95 | 97 | <0.6 |

TABLE 195

| ISIS No | 0.625 µM | 1.250 µM | 2.50 µM | 5.00 µM | 10.00 µM | IC$_{50}$ (µM) |
|---|---|---|---|---|---|---|
| 542101 | 90 | 97 | 97 | 97 | 95 | <0.6 |
| 542051 | 89 | 96 | 95 | 98 | 97 | <0.6 |
| 542106 | 83 | 93 | 96 | 96 | 98 | <0.6 |
| 542071 | 84 | 91 | 94 | 97 | 97 | <0.6 |
| 542094 | 85 | 92 | 94 | 97 | 98 | <0.6 |
| 542069 | 89 | 94 | 97 | 95 | 98 | <0.6 |
| 542086 | 83 | 94 | 96 | 97 | 98 | <0.6 |
| 542085 | 85 | 92 | 96 | 97 | 97 | <0.6 |
| 542053 | 64 | 83 | 94 | 98 | 97 | <0.6 |
| 542087 | 69 | 84 | 99 | 95 | 98 | <0.6 |
| 542109 | 87 | 94 | 96 | 98 | 98 | <0.6 |
| 542126 | 96 | 98 | 99 | 98 | 98 | <0.6 |
| 542127 | 94 | 96 | 97 | 98 | 97 | <0.6 |
| 542128 | 90 | 96 | 98 | 98 | 97 | <0.6 |

TABLE 196

| ISIS No | 0.625 µM | 1.250 µM | 2.50 µM | 5.00 µM | 10.00 µM | IC$_{50}$ (µM) |
|---|---|---|---|---|---|---|
| 542118 | 97 | 97 | 98 | 95 | 43 | <0.6 |
| 542186 | 93 | 96 | 98 | 99 | 98 | <0.6 |
| 542150 | 95 | 97 | 98 | 99 | 99 | <0.6 |

TABLE 196-continued

| ISIS No | 0.625 μM | 1.250 μM | 2.50 μM | 5.00 μM | 10.00 μM | IC$_{50}$ (μM) |
|---|---|---|---|---|---|---|
| 542122 | 90 | 94 | 98 | 98 | 99 | <0.6 |
| 542125 | 88 | 97 | 98 | 98 | 99 | <0.6 |
| 542145 | 90 | 96 | 98 | 99 | 99 | <0.6 |
| 542112 | 86 | 94 | 99 | 99 | 99 | <0.6 |
| 542149 | 88 | 93 | 99 | 98 | 99 | <0.6 |
| 542146 | 79 | 93 | 96 | 97 | 98 | <0.6 |
| 542153 | 87 | 94 | 97 | 98 | 99 | <0.6 |
| 542119 | 64 | 84 | 93 | 97 | 98 | <0.6 |
| 542137 | 76 | 91 | 97 | 97 | 98 | <0.6 |
| 542152 | 84 | 94 | 96 | 96 | 97 | <0.6 |
| 542157 | 83 | 95 | 98 | 99 | 98 | <0.6 |

TABLE 197

| ISIS No | 0.625 μM | 1.250 μM | 2.50 μM | 5.00 μM | 10.00 μM | IC$_{50}$ (μM) |
|---|---|---|---|---|---|---|
| 542185 | 82 | 93 | 96 | 96 | 94 | <0.6 |
| 542143 | 81 | 91 | 96 | 98 | 98 | <0.6 |
| 542144 | 77 | 93 | 95 | 96 | 99 | <0.6 |
| 542139 | 87 | 93 | 98 | 98 | 98 | <0.6 |
| 542134 | 83 | 90 | 90 | 95 | 96 | <0.6 |
| 545333 | 68 | 85 | 91 | 96 | 98 | <0.6 |
| 545373 | 57 | 73 | 86 | 92 | 97 | <0.6 |
| 545438 | 84 | 96 | 98 | 97 | 99 | <0.6 |
| 545431 | 77 | 91 | 93 | 97 | 98 | <0.6 |
| 545447 | 70 | 85 | 96 | 96 | 97 | <0.6 |
| 545417 | 62 | 82 | 90 | 93 | 95 | <0.6 |
| 545467 | 77 | 88 | 91 | 94 | 95 | <0.6 |
| 545441 | 63 | 82 | 92 | 94 | 96 | <0.6 |

Example 122

Dose-Dependent Antisense Inhibition of Human GHR in Hep3B Cells by Deoxy, MOE and (S)-cEt Gapmers Gapmers from studies described above exhibiting significant in vitro inhibition of GHR mRNA were selected and tested at various doses in Hep3B cells. The antisense oligonucleotides were tested in a series of experiments that had similar culture conditions. The results for each experiment are presented in separate tables shown below. Cells were plated at a density of 20,000 cells per well and transfected using electroporation with 0.04 μM, 0.11 μM, 0.33 μM, 1.00 μM, and 3.00 μM concentrations of antisense oligonucleotide. After a treatment period of approximately 16 hours, RNA was isolated from the cells and GHR mRNA levels were measured by quantitative real-time PCR. Human primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration (IC$_{50}$) of each oligonucleotide is also presented. GHR mRNA levels were significantly reduced in a dose-dependent manner in antisense oligonucleotide treated cells.

TABLE 198

| ISIS No | 0.04 μM | 0.11 μM | 0.33 μM | 1.00 μM | 3.00 μM | IC$_{50}$ (μM) |
|---|---|---|---|---|---|---|
| 539380 | 11 | 16 | 57 | 93 | 98 | 0.2 |
| 541724 | 0 | 27 | 71 | 66 | 83 | 0.3 |
| 541748 | 28 | 40 | 71 | 90 | 97 | 0.1 |
| 541767 | 19 | 38 | 54 | 87 | 98 | 0.2 |
| 541797 | 23 | 46 | 70 | 88 | 97 | 0.1 |
| 541766 | 15 | 26 | 49 | 82 | 96 | 0.3 |
| 541742 | 17 | 28 | 41 | 80 | 95 | 0.3 |
| 541750 | 33 | 27 | 60 | 89 | 98 | 0.2 |
| 541749 | 27 | 16 | 62 | 84 | 82 | 0.2 |
| 541793 | 0 | 14 | 44 | 77 | 96 | 0.4 |
| 541785 | 4 | 11 | 39 | 75 | 95 | 0.4 |
| 541752 | 14 | 6 | 45 | 70 | 94 | 0.4 |
| 541826 | 8 | 34 | 74 | 94 | 99 | 0.2 |
| 541811 | 6 | 4 | 45 | 79 | 97 | 0.4 |
| 541822 | 9 | 29 | 67 | 89 | 97 | 0.2 |

TABLE 199

| ISIS No | 0.04 μM | 0.11 μM | 0.33 μM | 1.00 μM | 3.00 μM | IC$_{50}$ (μM) |
|---|---|---|---|---|---|---|
| 539380 | 0 | 16 | 47 | 82 | 98 | 0.4 |
| 541819 | 3 | 12 | 50 | 76 | 94 | 0.3 |
| 541841 | 0 | 19 | 47 | 80 | 95 | 0.3 |
| 541825 | 0 | 6 | 40 | 74 | 96 | 0.4 |
| 541827 | 5 | 26 | 48 | 76 | 95 | 0.3 |
| 541835 | 7 | 11 | 33 | 74 | 93 | 0.4 |
| 541838 | 21 | 26 | 61 | 90 | 97 | 0.2 |
| 541833 | 0 | 9 | 41 | 63 | 89 | 0.5 |
| 541813 | 0 | 17 | 28 | 65 | 92 | 0.5 |
| 541842 | 5 | 15 | 30 | 72 | 90 | 0.4 |
| 541804 | 0 | 12 | 3 | 49 | 79 | 1.1 |
| 542024 | 0 | 0 | 26 | 54 | 76 | 1.0 |
| 542107 | 15 | 45 | 78 | 92 | 99 | 0.1 |
| 542105 | 2 | 14 | 55 | 88 | 98 | 0.3 |
| 542102 | 10 | 16 | 73 | 88 | 98 | 0.2 |

TABLE 200

| ISIS No | 0.04 μM | 0.11 μM | 0.33 μM | 1.00 μM | 3.00 μM | IC$_{50}$ (μM) |
|---|---|---|---|---|---|---|
| 539380 | 4 | 18 | 50 | 86 | 95 | 0.3 |
| 542108 | 15 | 13 | 65 | 86 | 97 | 0.2 |
| 542101 | 17 | 40 | 68 | 92 | 98 | 0.2 |
| 542106 | 4 | 23 | 56 | 88 | 98 | 0.3 |
| 542094 | 0 | 30 | 51 | 86 | 96 | 0.3 |
| 542086 | 13 | 38 | 50 | 84 | 97 | 0.2 |
| 542085 | 0 | 27 | 57 | 90 | 98 | 0.3 |
| 542087 | 7 | 3 | 49 | 80 | 92 | 0.4 |
| 542109 | 17 | 10 | 56 | 88 | 98 | 0.3 |
| 542126 | 40 | 63 | 91 | 96 | 99 | <0.03 |
| 542127 | 27 | 47 | 69 | 93 | 97 | 0.1 |
| 542128 | 11 | 30 | 66 | 90 | 98 | 0.2 |
| 542118 | 14 | 42 | 77 | 95 | 98 | 0.1 |
| 542150 | 31 | 46 | 72 | 94 | 98 | 0.1 |
| 542122 | 13 | 14 | 59 | 90 | 97 | 0.3 |

TABLE 201

| ISIS No | 0.04 μM | 0.11 μM | 0.33 μM | 1.00 μM | 3.00 μM | IC$_{50}$ (μM) |
|---|---|---|---|---|---|---|
| 539380 | 0 | 2 | 50 | 86 | 97 | 0.4 |
| 542125 | 31 | 32 | 69 | 89 | 96 | 0.1 |
| 542145 | 15 | 29 | 64 | 91 | 97 | 0.2 |
| 542112 | 14 | 38 | 61 | 87 | 96 | 0.2 |
| 542149 | 9 | 37 | 63 | 90 | 97 | 0.2 |
| 542146 | 13 | 33 | 59 | 82 | 95 | 0.2 |
| 542153 | 22 | 26 | 63 | 86 | 96 | 0.2 |

TABLE 201-continued

| ISIS No | 0.04 µM | 0.11 µM | 0.33 µM | 1.00 µM | 3.00 µM | IC$_{50}$ (µM) |
|---|---|---|---|---|---|---|
| 542119 | 10 | 20 | 34 | 70 | 87 | 0.4 |
| 542137 | 3 | 19 | 47 | 77 | 95 | 0.3 |
| 542152 | 0 | 9 | 47 | 82 | 96 | 0.4 |
| 542157 | 0 | 26 | 56 | 84 | 96 | 0.3 |
| 542143 | 8 | 12 | 44 | 81 | 95 | 0.3 |
| 542144 | 0 | 21 | 42 | 75 | 95 | 0.4 |
| 542139 | 0 | 14 | 46 | 82 | 97 | 0.4 |
| 542134 | 3 | 23 | 43 | 72 | 92 | 0.4 |

TABLE 202

| ISIS No | 0.04 µM | 0.11 µM | 0.33 µM | 1.00 µM | 3.00 µM | IC$_{50}$ (µM) |
|---|---|---|---|---|---|---|
| 539380 | 0 | 9 | 64 | 85 | 97 | 0.3 |
| 541870 | 7 | 15 | 48 | 80 | 92 | 0.3 |
| 541262 | 0 | 29 | 63 | 90 | 98 | 0.2 |
| 541863 | 0 | 26 | 40 | 82 | 93 | 0.4 |
| 541875 | 6 | 30 | 71 | 84 | 91 | 0.2 |
| 541853 | 0 | 13 | 39 | 67 | 91 | 0.5 |
| 541877 | 0 | 26 | 41 | 79 | 94 | 0.4 |
| 541881 | 0 | 30 | 54 | 87 | 94 | 0.3 |
| 541936 | 20 | 41 | 73 | 93 | 98 | 0.1 |
| 541909 | 0 | 16 | 34 | 64 | 90 | 0.5 |
| 541907 | 6 | 31 | 59 | 84 | 96 | 0.2 |
| 541952 | 0 | 0 | 50 | 72 | 92 | 0.5 |
| 541953 | 0 | 22 | 50 | 80 | 92 | 0.4 |
| 541914 | 0 | 0 | 46 | 76 | 93 | 0.4 |
| 541880 | 0 | 13 | 48 | 79 | 89 | 0.4 |

TABLE 203

| ISIS No | 0.04 µM | 0.11 µM | 0.33 µM | 1.00 µM | 3.00 µM | IC$_{50}$ (µM) |
|---|---|---|---|---|---|---|
| 539380 | 0 | 5 | 53 | 78 | 94 | 0.4 |
| 541903 | 12 | 20 | 26 | 62 | 88 | 0.5 |
| 541895 | 3 | 12 | 29 | 66 | 92 | 0.5 |
| 541882 | 2 | 0 | 27 | 65 | 86 | 0.7 |
| 541889 | 12 | 12 | 47 | 68 | 87 | 0.4 |
| 541930 | 0 | 6 | 40 | 59 | 85 | 0.6 |
| 541985 | 0 | 16 | 41 | 66 | 93 | 0.4 |
| 542031 | 1 | 0 | 22 | 55 | 80 | 0.8 |
| 541972 | 0 | 1 | 23 | 46 | 83 | 0.9 |
| 541991 | 4 | 35 | 42 | 67 | 89 | 0.4 |
| 542052 | 5 | 28 | 70 | 92 | 98 | 0.2 |
| 542080 | 0 | 18 | 54 | 87 | 96 | 0.3 |
| 542051 | 0 | 18 | 52 | 86 | 97 | 0.3 |
| 542071 | 5 | 3 | 51 | 74 | 95 | 0.4 |
| 542069 | 0 | 7 | 56 | 85 | 94 | 0.3 |

TABLE 204

| ISIS No | 0.04 µM | 0.11 µM | 0.33 µM | 1.00 µM | 3.00 µM | IC$_{50}$ (µM) |
|---|---|---|---|---|---|---|
| 539380 | 11 | 20 | 54 | 89 | 92 | 0.3 |
| 542053 | 6 | 14 | 38 | 69 | 74 | 0.6 |
| 542186 | 14 | 43 | 70 | 90 | 98 | 0.2 |
| 542185 | 0 | 26 | 48 | 80 | 96 | 0.3 |
| 545333 | 0 | 4 | 27 | 65 | 90 | 0.6 |
| 545336 | 0 | 15 | 24 | 43 | 79 | 0.9 |
| 545373 | 0 | 2 | 9 | 42 | 86 | 1.0 |
| 545438 | 0 | 24 | 56 | 81 | 92 | 0.3 |
| 545431 | 0 | 18 | 50 | 73 | 91 | 0.4 |
| 545447 | 0 | 15 | 34 | 78 | 93 | 0.4 |
| 545417 | 0 | 11 | 39 | 66 | 87 | 0.5 |
| 545467 | 12 | 16 | 37 | 76 | 93 | 0.4 |
| 545441 | 21 | 15 | 20 | 60 | 87 | 0.6 |
| 545439 | 17 | 24 | 49 | 82 | 91 | 0.3 |

Example 123

Dose-Dependent Antisense Inhibition of Rhesus Monkey GHR in LLC-MK2 Cells

Gapmers from studies described above exhibiting significant in vitro inhibition of GHR mRNA were selected and tested for their potency for rhesus GHR mRNA in LLC-MK2 cells. Cells were plated at a density of 20,000 cells per well and transfected using electroporation with 0.12 µM, 0.37 µM, 1.11 µM, 3.33 µM, and 10.00 µM concentrations of antisense oligonucleotide. After a treatment period of approximately 16 hours, RNA was isolated from the cells and GHR mRNA levels were measured by quantitative real-time PCR. Primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration (IC$_{50}$) of each oligonucleotide is also presented. GHR mRNA levels were significantly reduced in a dose-dependent manner in antisense oligonucleotide treated cells.

TABLE 205

| ISIS No | Chemistry | 0.12 µM | 0.37 µM | 1.11 µM | 3.33 µM | 10.00 µM | IC$_{50}$ (µM) |
|---|---|---|---|---|---|---|---|
| 541262 | Deoxy, MOE and (S)-cEt | 9 | 25 | 42 | 85 | 91 | 1.1 |
| 541742 | Deoxy, MOE and (S)-cEt | 0 | 24 | 19 | 58 | 77 | 3.2 |
| 541767 | Deoxy, MOE and (S)-cEt | 6 | 10 | 30 | 68 | 88 | 2.0 |
| 541875 | Deoxy, MOE and (S)-cEt | 7 | 19 | 64 | 84 | 96 | 0.9 |
| 541881 | Deoxy, MOE and (S)-cEt | 6 | 24 | 59 | 79 | 91 | 1.0 |
| 542101 | Deoxy, MOE and (S)-cEt | 0 | 5 | 38 | 71 | 81 | 2.0 |
| 542112 | Deoxy, MOE and (S)-cEt | 5 | 17 | 33 | 67 | 76 | 2.0 |
| 542118 | Deoxy, MOE and (S)-cEt | 1 | 6 | 35 | 68 | 86 | 2.0 |
| 542125 | Deoxy, MOE and (S)-cEt | 0 | 12 | 57 | 83 | 93 | 1.0 |
| 542127 | Deoxy, MOE and (S)-cEt | 1 | 0 | 30 | 68 | 84 | 2.4 |
| 542128 | Deoxy, MOE and (S)-cEt | 12 | 0 | 26 | 58 | 83 | 2.7 |
| 542153 | Deoxy, MOE and (S)-cEt | 4 | 0 | 0 | 36 | 59 | 6.6 |
| 542185 | Deoxy, MOE and (S)-cEt | 4 | 0 | 25 | 56 | 87 | 2.5 |
| 542186 | Deoxy, MOE and (S)-cEt | 15 | 23 | 51 | 73 | 90 | 1.1 |
| 542051 | Deoxy, MOE and (S)-cEt | 5 | 19 | 40 | 81 | 94 | 1.2 |

TABLE 206

| ISIS No | Chemistry | 0.12 µM | 0.37 µM | 1.11 µM | 3.33 µM | 10.00 µM | IC$_{50}$ (µM) |
|---|---|---|---|---|---|---|---|
| 523723 | 5-10-5 MOE | 23 | 14 | 31 | 43 | 71 | 3.5 |
| 532254 | 5-10-5 MOE | 29 | 35 | 42 | 69 | 87 | 0.8 |
| 532401 | 5-10-5 MOE | 27 | 28 | 46 | 73 | 88 | 1.2 |
| 533932 | 5-10-5 MOE | 10 | 24 | 48 | 70 | 92 | 1.2 |
| 539376 | 3-10-4 MOE | 21 | 8 | 8 | 35 | 81 | 4.3 |
| 539399 | 3-10-4 MOE | 2 | 10 | 14 | 18 | 57 | 8.3 |
| 539404 | 3-10-4 MOE | 39 | 12 | 25 | 27 | 57 | 7.7 |
| 539416 | 3-10-4 MOE | 24 | 35 | 44 | 79 | 89 | 1.0 |
| 539432 | 3-10-4 MOE | 9 | 29 | 42 | 73 | 89 | 1.2 |
| 541262 | Deoxy, MOE and (S)-cEt | 0 | 43 | 63 | 88 | 94 | 0.8 |
| 541742 | Deoxy, MOE and (S)-cEt | 3 | 19 | 35 | 56 | 85 | 1.9 |
| 541767 | Deoxy, MOE and (S)-cEt | 3 | 24 | 39 | 64 | 86 | 1.6 |
| 545439 | Deoxy, MOE and (S)-cEt | 19 | 15 | 43 | 74 | 80 | 1.7 |
| 545447 | Deoxy, MOE and (S)-cEt | 25 | 34 | 58 | 80 | 90 | 0.6 |

Example 124

Dose-Dependent Antisense Inhibition of GHR in Cynomolgus Primary Hepatocytes Gapmers from studies described above exhibiting significant in vitro inhibition of GHR mRNA were selected and tested for their potency for GHR mRNA in cynomolgus monkey primary hepatocytes. Cells were plated at a density of 20,000 cells per well and transfected using electroporation with 0.12 µM, 0.37 µM, 1.11 µM, 3.33 µM, and 10.00 µM concentrations of antisense oligonucleotide. After a treatment period of approximately 16 hours, RNA was isolated from the cells and GHR mRNA levels were measured by quantitative real-time PCR. Primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration (IC$_{50}$) of each oligonucleotide is also presented. GHR mRNA levels were significantly reduced in a dose-dependent manner in antisense oligonucleotide treated cells.

TABLE 207

| ISIS No | Chemistry | 0.12 µM | 0.37 µM | 1.11 µM | 3.33 µM | 10.00 µM | IC$_{50}$ (µM) |
|---|---|---|---|---|---|---|---|
| 541262 | Deoxy, MOE and (S)-cEt | 40 | 52 | 75 | 92 | 98 | 0.3 |
| 541742 | Deoxy, MOE and (S)-cEt | 40 | 57 | 51 | 91 | 96 | 0.2 |
| 541767 | Deoxy, MOE and (S)-cEt | 36 | 59 | 60 | 78 | 91 | 0.4 |
| 541875 | Deoxy, MOE and (S)-cEt | 54 | 76 | 88 | 95 | 95 | <0.1 |
| 541881 | Deoxy, MOE and (S)-cEt | 53 | 75 | 85 | 98 | 98 | <0.1 |
| 542101 | Deoxy, MOE and (S)-cEt | 38 | 55 | 78 | 89 | 97 | 0.2 |
| 542112 | Deoxy, MOE and (S)-cEt | 28 | 50 | 74 | 89 | 96 | 0.4 |
| 542118 | Deoxy, MOE and (S)-cEt | 20 | 45 | 69 | 84 | 91 | 0.5 |
| 542125 | Deoxy, MOE and (S)-cEt | 33 | 62 | 77 | 92 | 97 | 0.3 |
| 542127 | Deoxy, MOE and (S)-cEt | 30 | 50 | 65 | 86 | 92 | 0.4 |
| 542128 | Deoxy, MOE and (S)-cEt | 25 | 40 | 52 | 80 | 93 | 0.7 |
| 542153 | Deoxy, MOE and (S)-cEt | 10 | 31 | 51 | 73 | 85 | 1.0 |
| 542185 | Deoxy, MOE and (S)-cEt | 12 | 45 | 65 | 85 | 93 | 0.6 |
| 542186 | Deoxy, MOE and (S)-cEt | 36 | 54 | 74 | 90 | 96 | 0.3 |
| 542051 | Deoxy, MOE and (S)-cEt | 9 | 29 | 32 | 32 | 42 | >10 |

TABLE 208

| ISIS No | Chemistry | 0.12 µM | 0.37 µM | 1.11 µM | 3.33 µM | 10.00 µM | IC$_{50}$ (µM) |
|---|---|---|---|---|---|---|---|
| 523435 | 5-10-5 MOE | 35 | 47 | 61 | 74 | 85 | 0.5 |
| 523723 | 5-10-5 MOE | 4 | 16 | 40 | 66 | 86 | 1.8 |
| 532254 | 5-10-5 MOE | 14 | 15 | 24 | 16 | 9 | >10 |
| 532401 | 5-10-5 MOE | 37 | 54 | 73 | 88 | 94 | 0.3 |
| 533932 | 5-10-5 MOE | 23 | 40 | 69 | 78 | 86 | 0.6 |
| 539376 | 3-10-4 MOE | 3 | 0 | 44 | 65 | 91 | 2.0 |
| 539399 | 3-10-4 MOE | 0 | 0 | 9 | 42 | 67 | 5.0 |
| 539404 | 3-10-4 MOE | 0 | 0 | 26 | 52 | 71 | 3.5 |
| 539416 | 3-10-4 MOE | 8 | 29 | 62 | 89 | 93 | 0.7 |
| 539432 | 3-10-4 MOE | 0 | 24 | 55 | 85 | 93 | 0.9 |
| 541262 | Deoxy, MOE and (S)-cEt | 23 | 52 | 73 | 92 | 96 | 0.4 |
| 541742 | Deoxy, MOE and (S)-cEt | 15 | 51 | 73 | 86 | 97 | 0.5 |
| 541767 | Deoxy, MOE and (S)-cEt | 19 | 20 | 39 | 68 | 81 | 1.8 |
| 545439 | Deoxy, MOE and (S)-cEt | 0 | 0 | 30 | 61 | 90 | 2.4 |
| 545447 | Deoxy, MOE and (S)-cEt | 0 | 17 | 17 | 19 | 27 | >10 |

Example 125

Dose-Dependent Antisense Inhibition of GHR in Hep3B Cells

Gapmers from studies described above exhibiting significant in vitro inhibition of GHR mRNA were selected and tested for their potency for GHR mRNA at various doses in Hep3B cells. Cells were plated at a density of 20,000 cells per well and transfected using electroporation with 0.12 µM, 0.37 µM, 1.11 µM, 3.33 µM, and 10.00 µM concentrations of antisense oligonucleotide. After a treatment period of approximately 16 hours, RNA was isolated from the cells and GHR mRNA levels were measured by quantitative real-time PCR. Human primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration ($IC_{50}$) of each oligonucleotide is also presented. GHR mRNA levels were significantly reduced in a dose-dependent manner in antisense oligonucleotide treated cells.

TABLE 209

| ISIS No | 0.12 µM | 0.37 µM | 1.11 µM | 3.33 µM | 10.00 µM | $IC_{50}$ (µM) |
|---|---|---|---|---|---|---|
| 541262 | 25 | 43 | 76 | 85 | 94 | 0.5 |
| 541742 | 32 | 55 | 76 | 88 | 97 | 0.3 |
| 541767 | 29 | 56 | 83 | 89 | 97 | 0.3 |
| 541875 | 38 | 68 | 84 | 93 | 94 | 0.1 |
| 541881 | 32 | 57 | 81 | 94 | 97 | 0.3 |
| 542051 | 34 | 66 | 83 | 95 | 98 | 0.2 |
| 542101 | 25 | 55 | 85 | 95 | 98 | 0.3 |
| 542112 | 18 | 56 | 83 | 95 | 98 | 0.4 |
| 542118 | 42 | 61 | 88 | 95 | 97 | 0.1 |
| 542125 | 30 | 63 | 87 | 95 | 98 | 0.2 |
| 542127 | 50 | 70 | 91 | 91 | 98 | 0.1 |
| 542128 | 38 | 63 | 88 | 96 | 98 | 0.2 |
| 542153 | 37 | 59 | 85 | 94 | 97 | 0.2 |
| 542185 | 44 | 51 | 76 | 89 | 96 | 0.2 |
| 542186 | 46 | 59 | 84 | 95 | 97 | 0.1 |

TABLE 210

| ISIS No | 0.12 µM | 0.37 µM | 1.11 µM | 3.33 µM | 10.00 µM | $IC_{50}$ (µM) |
|---|---|---|---|---|---|---|
| 523435 | 9 | 26 | 49 | 78 | 93 | 1.0 |
| 523723 | 7 | 16 | 39 | 72 | 90 | 1.4 |
| 532254 | 36 | 46 | 69 | 86 | 94 | 0.4 |
| 532401 | 25 | 54 | 71 | 86 | 91 | 0.4 |
| 533932 | 8 | 47 | 69 | 80 | 94 | 0.7 |
| 539376 | 26 | 31 | 54 | 73 | 86 | 0.8 |
| 539399 | 23 | 43 | 72 | 89 | 94 | 0.5 |
| 539404 | 30 | 60 | 88 | 95 | 98 | 0.2 |
| 539416 | 30 | 59 | 84 | 93 | 98 | 0.3 |
| 539432 | 35 | 62 | 88 | 95 | 98 | 0.2 |
| 541262 | 43 | 60 | 84 | 89 | 98 | 0.2 |
| 541742 | 23 | 53 | 73 | 84 | 97 | 0.4 |
| 541767 | 22 | 49 | 74 | 85 | 92 | 0.4 |
| 545439 | 41 | 69 | 88 | 95 | 96 | 0.1 |
| 545447 | 31 | 47 | 63 | 74 | 82 | 0.5 |

Example 126

Dose-Dependent Antisense Inhibition of GHR in Cynomolgus Primary Hepatocytes

Gapmers from studies described above exhibiting significant in vitro inhibition of GHR mRNA were selected and tested at various doses in cynomolgous monkey primary hepatocytes. Cells were plated at a density of 35,000 cells per well and transfected using electroporation with 0.04 µM, 0.12 µM, 0.37 µM, 1.11 µM, 3.33 µM, and 10.00 µM concentrations of antisense oligonucleotide. After a treatment period of approximately 16 hours, RNA was isolated from the cells and GHR mRNA levels were measured by quantitative real-time PCR. Primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration ($IC_{50}$) of each oligonucleotide is also presented. GHR mRNA levels were significantly reduced in a dose-dependent manner in antisense oligonucleotide treated cells.

TABLE 211

| ISIS No | 0.04 µM | 0.12 µM | 0.37 µM | 1.11 µM | 3.33 µM | 10.00 µM | $IC_{50}$ (µM) |
|---|---|---|---|---|---|---|---|
| 541767 | 8 | 17 | 29 | 48 | 59 | 58 | 0.4 |
| 541875 | 20 | 39 | 48 | 51 | 55 | 58 | 0.2 |
| 541881 | 23 | 36 | 49 | 60 | 56 | 58 | 0.1 |
| 542112 | 23 | 21 | 35 | 42 | 54 | 68 | 0.5 |
| 542118 | 19 | 14 | 26 | 38 | 54 | 59 | 0.8 |
| 542153 | 17 | 20 | 27 | 39 | 46 | 52 | 2.2 |
| 542185 | 20 | 23 | 27 | 46 | 39 | 56 | 2.0 |
| 532254 | 1 | 20 | 23 | 11 | 1 | 23 | >10 |
| 532401 | 0 | 15 | 24 | 39 | 47 | 55 | 1.6 |
| 523723 | 0 | 0 | 7 | 24 | 49 | 54 | 2.0 |

Example 127

Comparative Analysis of Dose-Dependent Antisense Inhibition of GHR in Hep3B Cells ISIS 532401 was compared with specific antisense oligonucleotides disclosed in US 2006/0178325 by testing at various doses in Hep3B cells. The oligonucleotides were selected based on the potency demonstrated in studies described in the application. Cells were plated at a density of 20,000 cells per well and transfected using electroporation with 0.11 µM, 0.33 µM, 1.00 µM, 1.11 µM, 3.00 µM, and 9.00 µM concentrations of antisense oligonucleotide. After a treatment period of approximately 16 hours, RNA was isolated from the cells and GHR mRNA levels were measured by quantitative real-time PCR. Human primer probe set RTS3437_MGB was used to measure mRNA levels. GHR mRNA levels were adjusted according to total RNA content, as measured by RIBOGREEN®. Results are presented as percent inhibition of GHR, relative to untreated control cells.

The half maximal inhibitory concentration ($IC_{50}$) of each oligonucleotide is also presented. The results indicate that ISIS 532401 was markedly more potent than the most potent oligonucleotides of US 2006/0178325.

TABLE 212

| ISIS No | 0.11 µM | 0.33 µM | 1.00 µM | 3.00 µM | 9.00 µM | $IC_{50}$ (µM) |
|---|---|---|---|---|---|---|
| 227452 | 11 | 12 | 46 | 73 | 92 | 1.4 |
| 227488 | 26 | 25 | 39 | 76 | 88 | 1.2 |
| 272309 | 16 | 14 | 39 | 66 | 91 | 1.6 |
| 272322 | 13 | 20 | 44 | 70 | 86 | 1.4 |
| 272328 | 22 | 20 | 24 | 43 | 56 | 5.7 |
| 272338 | 22 | 24 | 52 | 71 | 85 | 1.1 |
| 532401 | 34 | 53 | 72 | 87 | 94 | 0.3 |

Example 128

Tolerability of 5-10-5 MOE Gapmers Targeting Human GHR in CD1 Mice

CD1® mice (Charles River, Mass.) are a multipurpose mice model, frequently utilized for safety and efficacy testing. The mice were treated with ISIS antisense oligonucleotides selected from studies described above and evaluated for changes in the levels of various plasma chemistry markers.

Treatment

Groups of eight- to ten-week old male CD1 mice were injected subcutaneously twice a week for 6 weeks with 50 mg/kg of ISIS oligonucleotides (100 mg/kg/week dose). One group of male CD1 mice was injected subcutaneously twice a week for 6 weeks with PBS. Mice were euthanized 48 hours after the last dose, and organs and plasma were harvested for further analysis.

Plasma Chemistry Markers

To evaluate the effect of ISIS oligonucleotides on liver and kidney function, plasma levels of transaminases, bilirubin, creatinine, and BUN were measured using an automated clinical chemistry analyzer (Hitachi Olympus AU400e, Melville, N.Y.). The results are presented in Table 213. ISIS oligonucleotides that caused changes in the levels of any of the liver or kidney function markers outside the expected range for antisense oligonucleotides were excluded in further studies.

TABLE 213

Plasma chemistry markers in CD1 mice plasma at week 6

|  | ALT (IU/L) | AST (IU/L) | Bilirubin (mg/dL) | Creatinine (mg/dL) | BUN (mg/dL) |
| --- | --- | --- | --- | --- | --- |
| PBS | 31 | 50 | 0.28 | 0.15 | 28 |
| ISIS 523271 | 366 | 285 | 0.18 | 0.11 | 29 |
| ISIS 523324 | 222 | 139 | 0.19 | 0.10 | 31 |
| ISIS 523604 | 2106 | 1157 | 0.41 | 0.06 | 48 |
| ISIS 532254 | 66 | 84 | 0.11 | 0.10 | 27 |
| ISIS 533121 | 176 | 155 | 0.19 | 0.09 | 27 |
| ISIS 533161 | 1094 | 904 | 0.23 | 0.07 | 29 |
| ISIS 533178 | 78 | 83 | 0.18 | 0.08 | 28 |
| ISIS 533234 | 164 | 147 | 0.21 | 0.09 | 26 |

Hematology Assays

Blood obtained from all mice groups were sent to Antech Diagnostics for hematocrit (HCT) measurements and analysis, as well as measurements of the various blood cells, such as WBC, RBC, and platelets, and total hemoglobin content. The results are presented in Table 214. ISIS oligonucleotides that caused changes in the levels of any of the hematology markers outside the expected range for antisense oligonucleotides were excluded in further studies.

TABLE 214

Hematology markers in CD1 mice plasma at week 6

|  | HCT (%) | Hemoglobin (g/dL) | RBC ($10^6/\mu L$) | WBC ($10^3/\mu L$) | Platelets ($10^3/\mu L$) |
| --- | --- | --- | --- | --- | --- |
| PBS | 45 | 13 | 8.2 | 4.1 | 689 |
| ISIS 523271 | 42 | 12 | 7.9 | 4.5 | 1181 |
| ISIS 523324 | 39 | 11 | 7.5 | 7.9 | 980 |
| ISIS 523604 | 33 | 10 | 6.9 | 14.1 | 507 |
| ISIS 532254 | 35 | 10 | 6.9 | 7.2 | 861 |
| ISIS 533121 | 39 | 12 | 7.9 | 8.4 | 853 |
| ISIS 533161 | 49 | 14 | 9.3 | 9.0 | 607 |
| ISIS 533178 | 44 | 13 | 8.5 | 6.9 | 765 |
| ISIS 533234 | 42 | 12 | 7.8 | 9.2 | 1045 |

Example 129

Tolerability of 5-10-5 MOE Gapmers Targeting Human GHR in CD1 Mice

CD1® mice were treated with ISIS antisense oligonucleotides selected from studies described above and evaluated for changes in the levels of various plasma chemistry markers.

Treatment

Groups of eight- to ten-week old male CD1 mice were injected subcutaneously twice a week for 6 weeks with 50 mg/kg of ISIS oligonucleotide (100 mg/kg/week dose). One group of male CD1 mice was injected subcutaneously twice a week for 6 weeks with PBS. Mice were euthanized 48 hours after the last dose, and organs and plasma were harvested for further analysis.

Plasma Chemistry Markers

To evaluate the effect of ISIS oligonucleotides on liver and kidney function, plasma levels of transaminases, bilirubin, creatinine, and BUN were measured using an automated clinical chemistry analyzer (Hitachi Olympus AU400e, Melville, N.Y.). The results are presented in Table 215. ISIS oligonucleotides that caused changes in the levels of any of the liver or kidney function markers outside the expected range for antisense oligonucleotides were excluded in further studies.

TABLE 215

Plasma chemistry markers in CD1 mice plasma at week 6

|  | ALT (IU/L) | AST (IU/L) | Bilirubin (mg/dL) | Creatinine (mg/dL) | BUN (mg/dL) |
| --- | --- | --- | --- | --- | --- |
| PBS | 30 | 59 | 0.26 | 0.14 | 20 |
| ISIS 523715 | 636 | 505 | 0.24 | 0.14 | 22 |
| ISIS 523723 | 57 | 80 | 0.20 | 0.16 | 23 |
| ISIS 523726 | 165 | 167 | 0.18 | 0.15 | 23 |
| ISIS 523736 | 140 | 177 | 0.20 | 0.15 | 23 |
| ISIS 523747 | 96 | 108 | 0.17 | 0.14 | 23 |
| ISIS 523789 | 45 | 74 | 0.20 | 0.15 | 22 |
| ISIS 532395 | 64 | 111 | 0.23 | 0.12 | 21 |
| ISIS 532401 | 47 | 88 | 0.21 | 0.17 | 22 |
| ISIS 532411 | 225 | 426 | 0.17 | 0.16 | 22 |
| ISIS 532420 | 60 | 99 | 0.21 | 0.12 | 25 |
| ISIS 532468 | 319 | 273 | 0.15 | 0.14 | 21 |
| ISIS 533932 | 62 | 81 | 0.18 | 0.14 | 21 |

Hematology Assays

Blood obtained from all mice groups were sent to Antech Diagnostics for hematocrit (HCT) measurements and analysis, as well as measurements of the various blood cells, such as WB), RBC, and platelets, and total hemoglobin content. The results are presented in Table 216. ISIS oligonucleotides that caused changes in the levels of any of the hematology markers outside the expected range for antisense oligonucleotides were excluded in further studies.

TABLE 216

Hematology markers in CD1 mice plasma at week 6

|  | HCT (%) | Hemoglobin (g/dL) | RBC ($10^6/\mu L$) | WBC ($10^3/\mu L$) | Platelets ($10^3/\mu L$) |
| --- | --- | --- | --- | --- | --- |
| PBS | 43 | 13 | 8.1 | 3.3 | 1047 |
| ISIS 523715 | 40 | 12 | 8.1 | 4.2 | 1153 |
| ISIS 523723 | 35 | 11 | 6.8 | 2.9 | 1154 |
| ISIS 523726 | 32 | 10 | 6.8 | 5.8 | 1056 |
| ISIS 523736 | 35 | 11 | 7.1 | 3.6 | 1019 |
| ISIS 523747 | 37 | 11 | 7.7 | 2.8 | 1146 |
| ISIS 523789 | 37 | 11 | 7.3 | 2.5 | 1033 |
| ISIS 532395 | 37 | 11 | 7.4 | 4.5 | 890 |
| ISIS 532401 | 36 | 11 | 7.1 | 3.7 | 1175 |
| ISIS 532411 | 27 | 8 | 5.3 | 3.2 | 641 |
| ISIS 532420 | 35 | 11 | 7.0 | 3.3 | 1101 |
| ISIS 532468 | 36 | 11 | 7.4 | 4.0 | 1043 |
| ISIS 533932 | 36 | 11 | 7.2 | 3.8 | 981 |

Example 130

Tolerability of 3-10-4 MOE Gapmers Targeting Human GHR in CD1 Mice

CD1® mice were treated with ISIS antisense oligonucleotides selected from studies described above and evaluated for changes in the levels of various plasma chemistry markers.

Treatment

Groups of eight- to ten-week old male CD1 mice were injected subcutaneously twice a week for 6 weeks with 50 mg/kg of ISIS oligonucleotide (100 mg/kg/week dose). One group of male CD1 mice was injected subcutaneously twice a week for 6 weeks with PBS. Mice were euthanized 48 hours after the last dose, and organs and plasma were harvested for further analysis.

Plasma Chemistry Markers

To evaluate the effect of ISIS oligonucleotides on liver and kidney function, plasma levels of transaminases, bilirubin, creatinine, and BUN were measured using an automated clinical chemistry analyzer (Hitachi Olympus AU400e, Melville, N.Y.). The results are presented in Table 217. ISIS oligonucleotides that caused changes in the levels of any of the liver or kidney function markers outside the expected range for antisense oligonucleotides were excluded in further studies.

TABLE 217

Plasma chemistry markers in CD1 mice plasma at week 6

| | ALT (IU/L) | AST (IU/L) | Bilirubin (mg/dL) | Creatinine (mg/dL) | BUN (mg/dL) |
|---|---|---|---|---|---|
| PBS | 48 | 63 | 0.20 | 0.13 | 28 |
| ISIS 539302 | 204 | 192 | 0.15 | 0.15 | 24 |
| ISIS 539321 | 726 | 455 | 0.17 | 0.12 | 27 |
| ISIS 539360 | 3287 | 2495 | 0.58 | 0.13 | 22 |
| ISIS 539361 | 310 | 226 | 0.17 | 0.11 | 21 |
| ISIS 539376 | 77 | 75 | 0.14 | 0.12 | 27 |
| ISIS 539379 | 134 | 136 | 0.16 | 0.13 | 24 |
| ISIS 539380 | 180 | 188 | 0.14 | 0.12 | 23 |
| ISIS 539383 | 80 | 81 | 0.15 | 0.12 | 25 |
| ISIS 539399 | 119 | 127 | 0.13 | 0.12 | 24 |
| ISIS 539401 | 1435 | 1172 | 0.24 | 0.11 | 24 |
| ISIS 539403 | 1543 | 883 | 0.18 | 0.12 | 26 |
| ISIS 539404 | 75 | 109 | 0.16 | 0.13 | 23 |
| ISIS 539416 | 100 | 107 | 0.19 | 0.15 | 26 |
| ISIS 539432 | 55 | 64 | 0.20 | 0.14 | 22 |
| ISIS 539433 | 86 | 91 | 0.12 | 0.13 | 22 |

Hematology Assays

Blood obtained from all mice groups were sent to Antech Diagnostics for hematocrit (HCT) measurements and analysis, as well as measurements of the various blood cells, such as WBC, RBC, and platelets, and total hemoglobin content. The results are presented in Table 218. ISIS oligonucleotides that caused changes in the levels of any of the hematology markers outside the expected range for antisense oligonucleotides were excluded in further studies.

TABLE 218

Hematology markers in CD1 mice plasma at week 6

| | HCT (%) | Hemoglobin (g/dL) | RBC ($10^6/\mu L$) | WBC ($10^3/\mu L$) | Platelets ($10^3/\mu L$) |
|---|---|---|---|---|---|
| PBS | 46 | 13 | 8.5 | 6 | 954 |
| ISIS 539302 | 40 | 11 | 8.1 | 13 | 830 |

TABLE 218-continued

Hematology markers in CD1 mice plasma at week 6

| | HCT (%) | Hemoglobin (g/dL) | RBC ($10^6/\mu L$) | WBC ($10^3/\mu L$) | Platelets ($10^3/\mu L$) |
|---|---|---|---|---|---|
| ISIS 539321 | 39 | 11 | 7.8 | 16 | 723 |
| ISIS 539360 | 49 | 14 | 9.0 | 14 | 671 |
| ISIS 539361 | 45 | 13 | 8.5 | 9 | 893 |
| ISIS 539376 | 42 | 12 | 7.7 | 6 | 988 |
| ISIS 539379 | 42 | 12 | 8.1 | 7 | 795 |
| ISIS 539380 | 38 | 10 | 7.7 | 8 | 950 |
| ISIS 539383 | 45 | 12 | 8.4 | 8 | 795 |
| ISIS 539399 | 41 | 12 | 8.0 | 10 | 895 |
| ISIS 539401 | 41 | 11 | 8.2 | 9 | 897 |
| ISIS 539403 | 33 | 9 | 6.2 | 13 | 1104 |
| ISIS 539404 | 42 | 12 | 8.4 | 7 | 641 |
| ISIS 539416 | 41 | 11 | 7.5 | 5 | 686 |
| ISIS 539432 | 44 | 12 | 8.0 | 6 | 920 |
| ISIS 539433 | 40 | 11 | 7.4 | 6 | 987 |

Example 131

Tolerability of Deoxy, MOE and (S)-cEt Gapmers Targeting Human GHR in CD1 Mice CD1® mice were treated with ISIS antisense oligonucleotides selected from studies described above and evaluated for changes in the levels of various plasma chemistry markers.

Treatment

Groups of eight- to ten-week old male CD1 mice were injected subcutaneously twice a week for 6 weeks with 25 mg/kg of ISIS oligonucleotide (50 mg/kg/week dose). One group of male CD1 mice was injected subcutaneously twice a week for 6 weeks with PBS. Mice were euthanized 48 hours after the last dose, and organs and plasma were harvested for further analysis.

Plasma Chemistry Markers

To evaluate the effect of ISIS oligonucleotides on liver and kidney function, plasma levels of transaminases, bilirubin, creatinine, and BUN were measured using an automated clinical chemistry analyzer (Hitachi Olympus AU400e, Melville, N.Y.). The results are presented in Table 219. ISIS oligonucleotides that caused changes in the levels of any of the liver or kidney function markers outside the expected range for antisense oligonucleotides were excluded in further studies.

TABLE 219

Plasma chemistry markers in CD1 mice plasma at week 6

| | ALT (IU/L) | AST (IU/L) | Bilirubin (mg/dL) | Creatinine (mg/dL) | BUN (mg/dL) |
|---|---|---|---|---|---|
| PBS | 36 | 71 | 0.22 | 0.18 | 22 |
| ISIS 541262 | 115 | 133 | 0.21 | 0.18 | 21 |
| ISIS 541724 | 543 | 531 | 0.34 | 0.17 | 21 |
| ISIS 541742 | 44 | 71 | 0.18 | 0.16 | 21 |
| ISIS 541748 | 269 | 582 | 0.16 | 0.15 | 22 |
| ISIS 541749 | 626 | 491 | 0.20 | 0.20 | 22 |
| ISIS 541750 | 1531 | 670 | 0.20 | 0.18 | 23 |
| ISIS 541766 | 2107 | 1139 | 0.21 | 0.21 | 23 |
| ISIS 541767 | 42 | 62 | 0.21 | 0.17 | 20 |
| ISIS 541822 | 493 | 202 | 0.13 | 0.16 | 22 |
| ISIS 541826 | 889 | 398 | 0.21 | 0.14 | 17 |
| ISIS 541838 | 266 | 172 | 0.16 | 0.15 | 20 |
| ISIS 541870 | 445 | 272 | 0.23 | 0.16 | 23 |
| ISIS 541875 | 103 | 114 | 0.20 | 0.15 | 20 |

TABLE 219-continued

Plasma chemistry markers in CD1 mice plasma at week 6

|  | ALT (IU/L) | AST (IU/L) | Bilirubin (mg/dL) | Creatinine (mg/dL) | BUN (mg/dL) |
|---|---|---|---|---|---|
| ISIS 541907 | 940 | 725 | 0.16 | 0.19 | 35 |
| ISIS 541991 | 1690 | 1733 | 0.31 | 0.20 | 23 |

Hematology Assays

Blood obtained from all mice groups were sent to Antech Diagnostics for hematocrit (HCT) measurements and analysis, as well as measurements of the various blood cells, such as WBC, RBC, and platelets, and total hemoglobin content. The results are presented in Table 220. ISIS oligonucleotides that caused changes in the levels of any of the hematology markers outside the expected range for antisense oligonucleotides were excluded in further studies.

TABLE 220

Hematology markers in CD1 mice plasma at week 6

|  | HCT (%) | Hemoglobin (g/dL) | RBC ($10^6/\mu L$) | WBC ($10^3/\mu L$) | Platelets ($10^3/\mu L$) |
|---|---|---|---|---|---|
| PBS | 37 | 11 | 7 | 3 | 1083 |
| ISIS 541262 | 38 | 11 | 7 | 6 | 1010 |
| ISIS 541724 | 52 | 16 | 10 | 9 | 940 |
| ISIS 541742 | 47 | 14 | 9 | 6 | 1134 |
| ISIS 541748 | 41 | 12 | 8 | 7 | 941 |
| ISIS 541749 | 41 | 12 | 8 | 5 | 1142 |
| ISIS 541750 | 42 | 12 | 8 | 4 | 1409 |
| ISIS 541766 | 39 | 11 | 7 | 7 | 989 |
| ISIS 541767 | 46 | 14 | 9 | 2 | 994 |
| ISIS 541822 | 42 | 12 | 8 | 3 | 1190 |
| ISIS 541826 | 41 | 12 | 8 | 10 | 1069 |
| ISIS 541838 | 44 | 13 | 8 | 6 | 1005 |
| ISIS 541870 | 38 | 11 | 7 | 8 | 1020 |
| ISIS 541875 | 44 | 13 | 8 | 6 | 1104 |
| ISIS 541907 | 40 | 11 | 8 | 9 | 1271 |
| ISIS 541991 | 34 | 10 | 6 | 6 | 1274 |

Example 132

Tolerability of Deoxy, MOE and (S)-cEt Gapmers Targeting Human GHR in CD1 Mice

CD1® mice were treated with ISIS antisense oligonucleotides selected from studies described above and evaluated for changes in the levels of various plasma chemistry markers. The 3-10-4 MOE gapmer ISIS 539376 was also included in the study.

Treatment

Groups of eight- to ten-week old male CD1 mice were injected subcutaneously twice a week for 6 weeks with 25 mg/kg of ISIS oligonucleotide (50 mg/kg/week dose). One group of male CD1 mice was injected subcutaneously twice a week for 6 weeks with PBS. Mice were euthanized 48 hours after the last dose, and organs and plasma were harvested for further analysis.

Plasma Chemistry Markers

To evaluate the effect of ISIS oligonucleotides on liver and kidney function, plasma levels of transaminases, bilirubin, creatinine, and BUN were measured using an automated clinical chemistry analyzer (Hitachi Olympus AU400e, Melville, N.Y.). The results are presented in Table 221. ISIS oligonucleotides that caused changes in the levels of any of the liver or kidney function markers outside the expected range for antisense oligonucleotides were excluded in further studies.

TABLE 221

Plasma chemistry markers in CD1 mice plasma at week 6

|  | ALT (IU/L) | AST (IU/L) | Bilirubin (mg/dL) | Creatinine (mg/dL) | BUN (mg/dL) |
|---|---|---|---|---|---|
| PBS | 43 | 66 | 0.21 | 0.11 | 20 |
| ISIS 541881 | 63 | 109 | 0.28 | 0.13 | 23 |
| ISIS 541936 | 3260 | 2108 | 0.40 | 0.13 | 24 |
| ISIS 542051 | 97 | 119 | 0.23 | 0.12 | 23 |
| ISIS 542052 | 454 | 236 | 0.23 | 0.12 | 25 |
| ISIS 542069 | 293 | 211 | 0.23 | 0.13 | 27 |
| ISIS 542085 | 91 | 87 | 0.18 | 0.10 | 21 |
| ISIS 542086 | 137 | 133 | 0.24 | 0.10 | 23 |
| ISIS 542094 | 86 | 143 | 0.23 | 0.13 | 21 |
| ISIS 542101 | 46 | 74 | 0.19 | 0.10 | 21 |
| ISIS 542102 | 4920 | 2432 | 2.30 | 0.15 | 29 |
| ISIS 542105 | 1255 | 575 | 0.35 | 0.13 | 21 |
| ISIS 542106 | 3082 | 2295 | 3.42 | 0.17 | 23 |
| ISIS 542107 | 4049 | 3092 | 0.50 | 0.14 | 20 |
| ISIS 542108 | 1835 | 859 | 0.32 | 0.11 | 21 |
| ISIS 539376 | 40 | 79 | 0.27 | 0.08 | 22 |

Hematology Assays

Blood obtained from all mice groups were sent to Antech Diagnostics for hematocrit (HCT) measurements and analysis, as well as measurements of the various blood cells, such as WBC, RBC, and total hemoglobin content. The results are presented in Table 222. ISIS oligonucleotides that caused changes in the levels of any of the hematology markers outside the expected range for antisense oligonucleotides were excluded in further studies.

TABLE 222

Hematology markers in CD1 mice plasma at week 6

|  | HCT (%) | Hemoglobin (g/dL) | RBC ($10^6/\mu L$) | WBC ($10^3/\mu L$) |
|---|---|---|---|---|
| PBS | 46 | 13 | 8 | 6 |
| ISIS 541881 | 53 | 15 | 10 | 7 |
| ISIS 541936 | 41 | 11 | 8 | 18 |
| ISIS 542051 | 49 | 14 | 9 | 8 |
| ISIS 542052 | 46 | 13 | 9 | 9 |
| ISIS 542069 | 43 | 13 | 8 | 7 |
| ISIS 542085 | 38 | 11 | 7 | 5 |
| ISIS 542086 | 49 | 14 | 9 | 9 |
| ISIS 542094 | 36 | 10 | 6 | 5 |
| ISIS 542101 | 44 | 13 | 9 | 5 |
| ISIS 542102 | 27 | 7 | 5 | 25 |
| ISIS 542105 | 42 | 12 | 8 | 7 |
| ISIS 542106 | 37 | 10 | 7 | 14 |
| ISIS 542107 | 41 | 12 | 7 | 17 |
| ISIS 542108 | 51 | 14 | 8 | 10 |
| ISIS 539376 | 49 | 14 | 10 | 5 |

Example 133

Tolerability of Deoxy, MOE and (S)-cEt Gapmers Targeting Human GHR in CD1 Mice

CD1® mice were treated with ISIS antisense oligonucleotides selected from studies described above and evaluated for changes in the levels of various plasma chemistry markers.

Treatment

Groups of eight- to ten-week old male CD1 mice were injected subcutaneously twice a week for 6 weeks with 25 mg/kg of ISIS oligonucleotide (50 mg/kg/week dose). One group of male CD1 mice was injected subcutaneously twice a week for 6 weeks with PBS. Mice were euthanized 48 hours after the last dose, and organs and plasma were harvested for further analysis.

Plasma Chemistry Markers

To evaluate the effect of ISIS oligonucleotides on liver and kidney function, plasma levels of transaminases, bilirubin, creatinine, and BUN were measured using an automated clinical chemistry analyzer (Hitachi Olympus AU400e, Melville, N.Y.). The results are presented in Table 223. ISIS oligonucleotides that caused changes in the levels of any of the liver or kidney function markers outside the expected range for antisense oligonucleotides were excluded in further studies.

TABLE 223

Plasma chemistry markers in CD1 mice plasma at week 6

|  | ALT (IU/L) | AST (IU/L) | Bilirubin (mg/dL) | Creatinine (mg/dL) | BUN (mg/dL) |
|---|---|---|---|---|---|
| PBS | 51 | 63 | 0.3 | 0.14 | 27 |
| ISIS 542109 | 3695 | 2391 | 0.8 | 0.19 | 24 |
| ISIS 542112 | 119 | 104 | 0.3 | 0.16 | 28 |
| ISIS 542118 | 66 | 86 | 0.3 | 0.15 | 26 |
| ISIS 542122 | 1112 | 350 | 0.3 | 0.16 | 27 |
| ISIS 542125 | 79 | 92 | 0.2 | 0.13 | 26 |
| ISIS 542126 | 381 | 398 | 0.5 | 0.14 | 23 |
| ISIS 542127 | 54 | 85 | 0.3 | 0.16 | 26 |
| ISIS 542128 | 55 | 89 | 0.2 | 0.12 | 24 |
| ISIS 542145 | 834 | 671 | 0.3 | 0.11 | 24 |
| ISIS 542146 | 163 | 107 | 0.2 | 0.14 | 30 |
| ISIS 542149 | 974 | 752 | 0.3 | 0.12 | 26 |
| ISIS 542150 | 2840 | 2126 | 2.4 | 0.17 | 23 |
| ISIS 542153 | 53 | 75 | 0.2 | 0.14 | 28 |
| ISIS 542157 | 137 | 122 | 0.3 | 0.13 | 25 |
| ISIS 542185 | 57 | 72 | 0.2 | 0.11 | 23 |
| ISIS 542186 | 62 | 84 | 0.2 | 0.12 | 24 |
| ISIS 545431 | 2622 | 1375 | 3.0 | 0.15 | 28 |
| ISIS 545438 | 1710 | 1000 | 0.3 | 0.14 | 26 |
| ISIS 545439 | 70 | 117 | 0.2 | 0.12 | 28 |
| ISIS 545447 | 141 | 108 | 0.3 | 0.13 | 26 |

Hematology Assays

Blood obtained from all mice groups were sent to Antech Diagnostics for hematocrit (HCT) measurements and analysis, as well as measurements of the various blood cells, such as WBC, RBC, and total hemoglobin content. The results are presented in Table 224. ISIS oligonucleotides that caused changes in the levels of any of the hematology markers outside the expected range for antisense oligonucleotides were excluded in further studies.

TABLE 224

Hematology markers in CD1 mice plasma at week 6

|  | HCT (%) | Hemoglobin (g/dL) | RBC (10⁶/μL) | WBC (10³/μL) | Platelets (10³/μL) |
|---|---|---|---|---|---|
| PBS | 40 | 12 | 7 | 6 | 1210 |
| ISIS 542109 | 47 | 13 | 9 | 16 | 1244 |
| ISIS 542112 | 50 | 13 | 8 | 7 | 1065 |
| ISIS 542118 | 42 | 12 | 8 | 8 | 1120 |
| ISIS 542122 | 37 | 11 | 7 | 7 | 1064 |
| ISIS 542125 | 42 | 13 | 8 | 7 | 1063 |
| ISIS 542126 | 34 | 10 | 7 | 9 | 1477 |
| ISIS 542127 | 41 | 12 | 7 | 7 | 1144 |
| ISIS 542128 | 40 | 12 | 7 | 6 | 1196 |
| ISIS 542145 | 42 | 12 | 8 | 8 | 1305 |
| ISIS 542146 | 45 | 13 | 8 | 7 | 1310 |
| ISIS 542149 | 33 | 10 | 6 | 12 | 903 |
| ISIS 542150 | 27 | 7 | 5 | 18 | 1202 |
| ISIS 542153 | 46 | 13 | 8 | 5 | 1130 |
| ISIS 542157 | 44 | 12 | 9 | 6 | 791 |
| ISIS 542185 | 45 | 13 | 8 | 3 | 1031 |

TABLE 224-continued

Hematology markers in CD1 mice plasma at week 6

|  | HCT (%) | Hemoglobin (g/dL) | RBC (10⁶/μL) | WBC (10³/μL) | Platelets (10³/μL) |
|---|---|---|---|---|---|
| ISIS 542186 | 44 | 12 | 8 | 6 | 985 |
| ISIS 545431 | 28 | 7 | 6 | 13 | 2609 |
| ISIS 545438 | 40 | 11 | 8 | 8 | 1302 |
| ISIS 545439 | 48 | 13 | 9 | 4 | 857 |
| ISIS 545447 | 45 | 13 | 9 | 9 | 964 |

Example 134

Tolerability of MOE Gapmers Targeting Human GHR in Sprague-Dawley Rats

Sprague-Dawley rats are a multipurpose model used for safety and efficacy evaluations. The rats were treated with ISIS antisense oligonucleotides from the studies described in the Examples above and evaluated for changes in the levels of various plasma chemistry markers.

Treatment

Male Sprague-Dawley rats were maintained on a 12-hour light/dark cycle and fed ad libitum with Purina normal rat chow, diet 5001. Groups of 4 Sprague-Dawley rats each were injected subcutaneously twice a week for 6 weeks with 50 mg/kg of ISIS oligonucleotide (100 mg/kg weekly dose). Forty eight hours after the last dose, rats were euthanized and organs and plasma were harvested for further analysis.

Liver Function

To evaluate the effect of ISIS oligonucleotides on hepatic function, plasma levels of transaminases were measured using an automated clinical chemistry analyzer (Hitachi Olympus AU400e, Melville, N.Y.). Plasma levels of ALT (alanine transaminase) and AST (aspartate transaminase) were measured and the results are presented in Table 225 expressed in IU/L. Plasma levels of bilirubin were also measured using the same clinical chemistry analyzer and the results are also presented in Table 225 expressed in mg/dL. ISIS oligonucleotides that caused changes in the levels of any markers of liver function outside the expected range for antisense oligonucleotides were excluded in further studies.

TABLE 225

Liver function markers in Sprague-Dawley rats

|  | ALT (IU/L) | AST (IU/L) | Bilirubin (mg/dL) |
|---|---|---|---|
| PBS | 69 | 90 | 0.15 |
| ISIS 523723 | 79 | 123 | 0.12 |
| ISIS 523789 | 71 | 105 | 0.15 |
| ISIS 532254 | 67 | 97 | 0.14 |
| ISIS 532401 | 61 | 77 | 0.12 |
| ISIS 532420 | 102 | 127 | 0.17 |
| ISIS 533178 | 157 | 219 | 0.34 |
| ISIS 533234 | 71 | 90 | 0.11 |
| ISIS 533932 | 58 | 81 | 0.12 |
| ISIS 539376 | 75 | 101 | 0.14 |
| ISIS 539380 | 86 | 128 | 0.16 |
| ISIS 539383 | 64 | 94 | 0.14 |
| ISIS 539399 | 52 | 95 | 0.14 |
| ISIS 539404 | 88 | 118 | 0.13 |
| ISIS 539416 | 63 | 104 | 0.14 |

TABLE 225-continued

Liver function markers in Sprague-Dawley rats

|  | ALT (IU/L) | AST (IU/L) | Bilirubin (mg/dL) |
|---|---|---|---|
| ISIS 539432 | 63 | 90 | 0.13 |
| ISIS 539433 | 69 | 92 | 0.13 |

Kidney Function

To evaluate the effect of ISIS oligonucleotides on kidney function, plasma levels of blood urea nitrogen (BUN) and creatinine were measured using an automated clinical chemistry analyzer (Hitachi Olympus AU400e, Melville, N.Y.). Results are presented in Table 226, expressed in mg/dL. ISIS oligonucleotides that caused changes in the levels of any of the kidney function markers outside the expected range for antisense oligonucleotides were excluded in further studies.

TABLE 226

Kidney function markers (mg/dL) in Sprague-Dawley rats

|  | BUN | Creatinine |
|---|---|---|
| PBS | 24 | 0.32 |
| ISIS 523723 | 20 | 0.39 |
| ISIS 523789 | 19 | 0.37 |
| ISIS 532254 | 21 | 0.43 |
| ISIS 532401 | 17 | 0.36 |
| ISIS 532420 | 20 | 0.31 |
| ISIS 533178 | 20 | 0.43 |
| ISIS 533234 | 22 | 0.41 |
| ISIS 533932 | 19 | 0.43 |
| ISIS 539376 | 19 | 0.36 |
| ISIS 539380 | 18 | 0.35 |
| ISIS 539383 | 19 | 0.35 |
| ISIS 539399 | 18 | 0.39 |
| ISIS 539404 | 23 | 0.39 |
| ISIS 539416 | 17 | 0.39 |
| ISIS 539432 | 20 | 0.39 |
| ISIS 539433 | 20 | 0.34 |

Hematology Assays

Blood obtained from all rat groups were sent to Antech Diagnostics for hematocrit (HCT) measurements and analysis, as well as measurements of the various blood cells, such as WBC, RBC, and total hemoglobin content. The results are presented in Table 227. ISIS oligonucleotides that caused changes in the levels of any of the hematology markers outside the expected range for antisense oligonucleotides were excluded in further studies.

TABLE 227

Hematology markers in Sprague-Dawley rats

|  | HCT (%) | Hemoglobin (g/dL) | RBC ($10^6$/μL) | WBC ($10^3$/μL) | Platelets ($10^3$/μL) |
|---|---|---|---|---|---|
| PBS | 46 | 15 | 8 | 11 | 1078 |
| ISIS 523723 | 38 | 12 | 7 | 19 | 626 |
| ISIS 523789 | 38 | 12 | 8 | 12 | 702 |
| ISIS 532254 | 36 | 12 | 7 | 11 | 547 |
| ISIS 532401 | 42 | 14 | 8 | 12 | 858 |
| ISIS 532420 | 37 | 12 | 7 | 17 | 542 |
| ISIS 533178 | 37 | 12 | 7 | 15 | 1117 |
| ISIS 533234 | 38 | 12 | 7 | 8 | 657 |
| ISIS 533932 | 40 | 13 | 7 | 9 | 999 |
| ISIS 539376 | 43 | 14 | 9 | 8 | 910 |
| ISIS 539380 | 33 | 11 | 5 | 6 | 330 |
| ISIS 539383 | 39 | 13 | 7 | 10 | 832 |
| ISIS 539399 | 37 | 11 | 7 | 4 | 603 |
| ISIS 539404 | 37 | 12 | 7 | 6 | 639 |

TABLE 227-continued

Hematology markers in Sprague-Dawley rats

|  | HCT (%) | Hemoglobin (g/dL) | RBC ($10^6$/μL) | WBC ($10^3$/μL) | Platelets ($10^3$/μL) |
|---|---|---|---|---|---|
| ISIS 539416 | 33 | 11 | 6 | 9 | 601 |
| ISIS 539432 | 44 | 14 | 9 | 10 | 810 |
| ISIS 539433 | 38 | 12 | 7 | 9 | 742 |

Organ Weights

Liver, heart, spleen and kidney weights were measured at the end of the study, and are presented in Table 228. ISIS oligonucleotides that caused any changes in organ weights outside the expected range for antisense oligonucleotides were excluded from further studies.

TABLE 228

Organ weights (g)

|  | Heart | Liver | Spleen | Kidney |
|---|---|---|---|---|
| PBS | 0.35 | 3.6 | 0.2 | 0.8 |
| ISIS 523723 | 0.31 | 4.9 | 0.7 | 0.8 |
| ISIS 523789 | 0.34 | 4.8 | 0.6 | 0.8 |
| ISIS 532254 | 0.32 | 5.0 | 0.6 | 1.0 |
| ISIS 532401 | 0.32 | 3.8 | 0.4 | 0.8 |
| ISIS 532420 | 0.29 | 4.6 | 0.7 | 1.0 |
| ISIS 533178 | 0.34 | 5.2 | 0.7 | 0.9 |
| ISIS 533234 | 0.30 | 4.4 | 0.6 | 1.0 |
| ISIS 533932 | 0.31 | 3.9 | 0.5 | 0.9 |
| ISIS 539376 | 0.29 | 4.4 | 0.4 | 0.8 |
| ISIS 539380 | 0.31 | 6.3 | 1.6 | 1.2 |
| ISIS 539383 | 0.31 | 4.5 | 0.6 | 1.0 |
| ISIS 539399 | 0.31 | 4.5 | 0.8 | 1.0 |
| ISIS 539404 | 0.34 | 4.9 | 0.6 | 1.0 |
| ISIS 539416 | 0.32 | 4.7 | 0.7 | 0.9 |
| ISIS 539432 | 0.30 | 3.8 | 0.4 | 0.8 |
| ISIS 539433 | 0.28 | 4.1 | 0.7 | 1.0 |

Example 135

Tolerability of Deoxy, MOE, and (S)-cEt Gapmers Targeting Human GHR in Sprague-Dawley Rats Sprague-Dawley rats were treated with ISIS antisense oligonucleotides from the studies described in the Examples above and evaluated for changes in the levels of various plasma chemistry markers.

Treatment

Male Sprague-Dawley rats were maintained on a 12-hour light/dark cycle and fed ad libitum with Purina normal rat chow, diet 5001. Groups of 4 Sprague-Dawley rats each were injected subcutaneously once a week for 6 weeks with 50 mg/kg of ISIS oligonucleotide (50 mg/kg weekly dose). Two groups of rats were injected subcutaneously once a week for 6 weeks with PBS. Forty eight hours after the last dose, rats were euthanized and organs and plasma were harvested for further analysis.

Liver Function

To evaluate the effect of ISIS oligonucleotides on hepatic function, plasma levels of transaminases were measured using an automated clinical chemistry analyzer (Hitachi Olympus AU400e, Melville, N.Y.). Plasma levels of ALT and AST were measured and the results are presented in Table 229 expressed in IU/L. Plasma levels of bilirubin were also measured using the same clinical chemistry analyzer and the results are also presented in Table 229 expressed in mg/dL. ISIS oligonucleotides that caused changes in the levels of any markers of liver function outside the expected range for antisense oligonucleotides were excluded in further studies.

TABLE 229

Liver function markers in Sprague-Dawley rats

|  | ALT (IU/L) | AST (IU/L) | Bilirubin (mg/dL) |
|---|---|---|---|
| PBS | 34 | 56 | 0.08 |
| PBS | 37 | 54 | 0.09 |
| ISIS 541881 | 53 | 77 | 0.12 |
| ISIS 542051 | 61 | 96 | 0.09 |
| ISIS 542101 | 64 | 214 | 0.10 |
| ISIS 542112 | 46 | 72 | 0.10 |
| ISIS 542118 | 42 | 60 | 0.08 |
| ISIS 542125 | 39 | 67 | 0.10 |
| ISIS 542127 | 56 | 75 | 0.12 |
| ISIS 542128 | 45 | 71 | 0.12 |
| ISIS 542153 | 44 | 69 | 0.11 |
| ISIS 542185 | 44 | 93 | 0.09 |
| ISIS 542186 | 51 | 107 | 0.12 |
| ISIS 545439 | 41 | 73 | 0.10 |
| ISIS 545447 | 103 | 114 | 0.10 |
| ISIS 541262 | 106 | 133 | 0.12 |
| ISIS 541742 | 56 | 102 | 0.11 |
| ISIS 541767 | 53 | 69 | 0.09 |
| ISIS 541875 | 70 | 133 | 0.08 |

Kidney Function

To evaluate the effect of ISIS oligonucleotides on kidney function, plasma levels of blood urea nitrogen (BUN) and creatinine were measured using an automated clinical chemistry analyzer (Hitachi Olympus AU400e, Melville, N.Y.). Results are presented in Table 230, expressed in mg/dL. ISIS oligonucleotides that caused changes in the levels of any of the kidney function markers outside the expected range for antisense oligonucleotides were excluded in further studies.

TABLE 230

Kidney function markers (mg/dL) in Sprague-Dawley rats

|  | BUN | Creatinine |
|---|---|---|
| PBS | 16 | 0.2 |
| PBS | 15 | 0.2 |
| ISIS 541881 | 22 | 0.3 |
| ISIS 542051 | 18 | 0.2 |
| ISIS 542101 | 22 | 0.3 |
| ISIS 542112 | 18 | 0.2 |
| ISIS 542118 | 18 | 0.3 |
| ISIS 542125 | 18 | 0.3 |
| ISIS 542127 | 19 | 0.3 |
| ISIS 542128 | 18 | 0.3 |
| ISIS 542153 | 17 | 0.3 |
| ISIS 542185 | 19 | 0.3 |
| ISIS 542186 | 19 | 0.3 |
| ISIS 545439 | 16 | 0.2 |
| ISIS 545447 | 16 | 0.2 |
| ISIS 541262 | 21 | 0.4 |
| ISIS 541742 | 19 | 0.2 |
| ISIS 541767 | 15 | 0.2 |
| ISIS 541875 | 16 | 0.2 |

Hematology Assays

Blood obtained from all rat groups were sent to Antech Diagnostics for hematocrit (HCT) measurements and analysis, as well as measurements of the various blood cells, such as WBC, RBC, and total hemoglobin content. The results are presented in Table 231. ISIS oligonucleotides that caused changes in the levels of any of the hematology markers outside the expected range for antisense oligonucleotides were excluded in further studies.

TABLE 231

Hematology markers in Sprague-Dawley rats

|  | HCT (%) | Hemoglobin (g/dL) | RBC ($10^6/\mu L$) | WBC ($10^3/\mu L$) | Platelets ($10^3/\mu L$) |
|---|---|---|---|---|---|
| PBS | 43 | 14 | 7 | 7 | 775 |
| PBS | 49 | 15 | 8 | 8 | 1065 |
| ISIS 541881 | 41 | 13 | 8 | 6 | 553 |
| ISIS 542051 | 39 | 13 | 7 | 9 | 564 |
| ISIS 542101 | 37 | 12 | 7 | 15 | 603 |
| ISIS 542112 | 45 | 14 | 8 | 10 | 587 |
| ISIS 542118 | 47 | 15 | 8 | 7 | 817 |
| ISIS 542125 | 41 | 13 | 7 | 7 | 909 |
| ISIS 542127 | 44 | 14 | 8 | 10 | 872 |
| ISIS 542128 | 44 | 14 | 8 | 7 | 679 |
| ISIS 542153 | 48 | 15 | 8 | 7 | 519 |
| ISIS 542185 | 44 | 14 | 8 | 9 | 453 |
| ISIS 542186 | 44 | 14 | 8 | 12 | 433 |
| ISIS 545439 | 40 | 12 | 7 | 11 | 733 |
| ISIS 545447 | 43 | 13 | 8 | 9 | 843 |
| ISIS 541262 | 46 | 14 | 8 | 17 | 881 |
| ISIS 541742 | 47 | 15 | 8 | 10 | 813 |
| ISIS 541767 | 53 | 16 | 9 | 9 | 860 |
| ISIS 541875 | 42 | 13 | 7 | 9 | 840 |

Organ Weights

Liver, heart, spleen and kidney weights were measured at the end of the study, and are presented in Table 232. ISIS oligonucleotides that caused any changes in organ weights outside the expected range for antisense oligonucleotides were excluded from further studies.

TABLE 232

Organ weights (g)

|  | Heart | Liver | Spleen | Kidney |
|---|---|---|---|---|
| PBS | 0.4 | 3.7 | 0.2 | 0.9 |
| PBS | 0.3 | 3.2 | 0.2 | 0.7 |
| ISIS 541881 | 0.4 | 3.4 | 0.4 | 0.9 |
| ISIS 542051 | 0.4 | 3.8 | 0.4 | 1.0 |
| ISIS 542101 | 0.3 | 4.2 | 0.6 | 1.1 |
| ISIS 542112 | 0.3 | 3.7 | 0.4 | 0.8 |
| ISIS 542118 | 0.4 | 3.6 | 0.2 | 0.8 |
| ISIS 542125 | 0.4 | 3.7 | 0.3 | 1.1 |
| ISIS 542127 | 0.3 | 4.2 | 0.3 | 0.8 |
| ISIS 542128 | 0.3 | 3.5 | 0.3 | 0.8 |
| ISIS 542153 | 0.3 | 3.5 | 0.3 | 0.8 |
| ISIS 542185 | 0.4 | 3.8 | 0.4 | 0.9 |
| ISIS 542186 | 0.3 | 3.8 | 0.6 | 0.9 |
| ISIS 545439 | 0.4 | 4.1 | 0.3 | 0.9 |
| ISIS 545447 | 0.4 | 3.4 | 0.3 | 1.1 |
| ISIS 541262 | 0.3 | 3.4 | 0.3 | 2.0 |
| ISIS 541742 | 0.3 | 3.8 | 0.3 | 0.8 |
| ISIS 541767 | 0.3 | 3.4 | 0.2 | 0.8 |
| ISIS 541875 | 0.3 | 5.2 | 0.4 | 1.0 |

Example 136

Effect of ISIS Antisense Oligonucleotides Targeting Human GHR in Cynomolgus Monkeys Cynomolgus monkeys were treated with ISIS antisense oligonucleotides selected from studies described in the Examples above. Antisense oligonucleotide efficacy and tolerability, as well as their pharmacokinetic profile in the liver and kidney, were evaluated.

At the time this study was undertaken, the cynomolgus monkey genomic sequence was not available in the National Center for Biotechnology Information (NCBI) database; therefore, cross-reactivity with the cynomolgus monkey gene sequence could not be confirmed. Instead, the sequences of the ISIS antisense oligonucleotides used in the cynomolgus monkeys was compared to a rhesus monkey sequence for homology. It is expected that ISIS oligonucleotides with homology to the rhesus monkey sequence are fully cross-reactive with the cynomolgus monkey sequence as well. The human antisense oligonucleotides tested are cross-reactive with the rhesus genomic sequence (GEN-BANK Accession No. NW_001120958.1 truncated from nucleotides 4410000 to 4720000, designated herein as SEQ ID NO: 2332). The greater the complementarity between the human oligonucleotide and the rhesus monkey sequence, the more likely the human oligonucleotide can cross-react with the rhesus monkey sequence. The start and stop sites of each oligonucleotide to SEQ ID NO: 2332 is presented in Table 233. "Start site" indicates the 5'-most nucleotide to which the gapmer is targeted in the rhesus monkey gene sequence.

TABLE 233

Antisense oligonucleotides complementary to the rhesus GHR genomic sequence (SEQ ID NO: 2332)

| ISIS No | Target Start Site | Target Stop Site | Chemistry | SEQ ID NO |
|---|---|---|---|---|
| 523723 | 149071 | 149090 | 5-10-5 MOE | 918 |
| 532254 | 64701 | 64720 | 5-10-5 MOE | 479 |
| 532401 | 147560 | 147579 | 5-10-5 MOE | 703 |
| 541767 | 152700 | 152715 | Deoxy, MOE and (S)-cEt | 1800 |
| 541875 | 210099 | 210114 | Deoxy, MOE and (S)-cEt | 1904 |
| 542112 | 146650 | 146665 | Deoxy, MOE and (S)-cEt | 2122 |
| 542118 | 149074 | 149089 | Deoxy, MOE and (S)-cEt | 2127 |
| 542185 | 245782 | 245797 | Deoxy, MOE and (S)-cEt | 2194 |

Treatment

Prior to the study, the monkeys were kept in quarantine during which the animals were observed daily for general health. The monkeys were 2-4 years old and weighed between 2 and 4 kg. Nine groups of 5 randomly assigned male cynomolgus monkeys each were injected subcutaneously with ISIS oligonucleotide or PBS using a stainless steel dosing needle and syringe of appropriate size into the intracapsular region and outer thigh of the monkeys. The monkeys were dosed three times (days 1, 4, and 7) for the first week, and then subsequently once a week for 12 weeks with 40 mg/kg of ISIS oligonucleotide. A control group of 5 cynomolgus monkeys was injected with PBS in a similar manner and served as the control group.

During the study period, the monkeys were observed twice daily for signs of illness or distress. Any animal experiencing more than momentary or slight pain or distress due to the treatment, injury or illness was treated by the veterinary staff with approved analgesics or agents to relieve the pain after consultation with the Study Director. Any animal in poor health or in a possible moribund condition was identified for further monitoring and possible euthanasia. Scheduled euthanasia of the animals was conducted on day 86 by exsanguination after ketamine/xylazine-induced anesthesia and administration of sodium pentobarbital. The protocols described in the Example were approved by the Institutional Animal Care and Use Committee (IACUC).

Hepatic Target Reduction

RNA Analysis

On day 86, RNA was extracted from liver, white adipose tissue (WAT) and kidney for real-time PCR analysis of measurement of mRNA expression of GHR. Results are presented as percent change of mRNA, relative to PBS control, normalized with RIBOGREEN®. 'n.d.' indicates that the data for that particular oligonucleotide was not measured. As shown in Table 234, treatment with ISIS antisense oligonucleotides resulted in significant reduction of GHR mRNA in comparison to the PBS control. Specifically, treatment with ISIS 532401 resulted in significant reduction of mRNA expression in all tissues.

TABLE 234

Percent inhibition of GHR mRNA in the cynomolgus monkey liver relative to the PBS control

| ISIS No | Liver | Kidney | WAT |
|---|---|---|---|
| 532401 | 60 | 47 | 59 |
| 532254 | 63 | 65 | n.d. |
| 523723 | 38 | 0 | n.d. |
| 542112 | 61 | 60 | 36 |
| 542118 | 0 | 22 | 27 |
| 542185 | 66 | 53 | n.d. |
| 541767 | 0 | 14 | n.d. |
| 541875 | 34 | 77 | n.d. |

Protein Analysis

Approximately 1 mL of blood was collected from all available animals at day 85 and placed in tubes containing the potassium salt of EDTA. The tubes were centrifuged (3000 rpm for 10 min at room temperature) to obtain plasma. Plasma levels of IGF-1 and GH were measured in the plasma. The results are presented in Table 235. The results indicate that treatment with ISIS oligonucleotides resulted in reduced IGF-1 protein levels.

TABLE 235

Plasma protein levels in the cynomolgus monkey

| | IGF-1 (% baseline) | GH (ng/mL) |
|---|---|---|
| PBS | 121 | 19 |
| 532401 | 57 | 39 |
| 532254 | 51 | 26 |
| 523723 | 77 | 16 |
| 542112 | 46 | 48 |
| 542118 | 97 | 6 |
| 542185 | 59 | 32 |
| 541767 | 101 | 22 |
| 541875 | 45 | 47 |

Tolerability Studies

Body and Organ Weight Measurements

To evaluate the effect of ISIS oligonucleotides on the overall health of the animals, body and organ weights were measured. Body weights were measured on day 84 and are presented in Table 236. Organ weights were measured on day 86 and the data is also presented in Table 236. The results indicate that effect of treatment with antisense oligonucleotides on body and organ weights was within the expected range for antisense oligonucleotides. Specifically, treatment with ISIS 532401 was well tolerated in terms of the body and organ weights of the monkeys.

TABLE 236

Final body and organ weights in cynomolgus monkey

|  | Body Wt (kg) | Spleen (g) | Kidney (g) | Liver (g) |
|---|---|---|---|---|
| PBS | 2.7 | 2.8 | 12.3 | 56.7 |
| 532401 | 2.6 | 4.0 | 11.5 | 58.5 |
| 532254 | 2.6 | 4.8 | 15.4 | 69.5 |
| 523723 | 2.8 | 3.1 | 14.8 | 69.4 |
| 542112 | 2.6 | 3.5 | 13.6 | 60.0 |
| 542118 | 2.7 | 2.7 | 11.9 | 58.6 |
| 542185 | 2.6 | 5.5 | 17.2 | 68.5 |
| 541767 | 2.8 | 5.1 | 11.7 | 65.1 |
| 541875 | 2.8 | 5.5 | 13.2 | 55.0 |

Liver Function

To evaluate the effect of ISIS oligonucleotides on hepatic function, blood samples were collected from all the study groups. The blood samples were collected via femoral venipuncture, 48 hrs post-dosing. The monkeys were fasted overnight prior to blood collection. Blood was collected in tubes containing $K_2$-EDTA anticoagulant, which were centrifuged to obtain plasma. Levels of various liver function markers were measured using a Toshiba 200FR NEO chemistry analyzer (Toshiba Co., Japan). Plasma levels of ALT and AST and bilirubin were measured. The results indicate that antisense oligonucleotides had no effect on liver function outside the expected range for antisense oligonucleotides. Specifically, treatment with ISIS 532401 was well tolerated in terms of the liver function in monkeys.

Kidney Function

To evaluate the effect of ISIS oligonucleotides on kidney function, blood samples were collected from all the study groups. The blood samples were collected via femoral venipuncture, 48 hrs post-dosing. The monkeys were fasted overnight prior to blood collection. Blood was collected in tubes containing $K_2$-EDTA anticoagulant, which were centrifuged to obtain plasma. Levels of BUN and creatinine were measured using a Toshiba 200FR NEO chemistry analyzer (Toshiba Co., Japan).

The plasma chemistry data indicate that most of the ISIS oligonucleotides did not have any effect on the kidney function outside the expected range for antisense oligonucleotides. Specifically, treatment with ISIS 532401 was well tolerated in terms of the kidney function of the monkeys.

Hematology

To evaluate any effect of ISIS oligonucleotides in cynomolgus monkeys on hematologic parameters, blood samples of approximately 1.3 mL of blood was collected from each of the available study animals in tubes containing $K_2$-EDTA. Samples were analyzed for red blood cell (RBC) count, white blood cells (WBC) count, individual white blood cell counts, such as that of monocytes, neutrophils, lymphocytes, as well as for platelet count, hemoglobin content and hematocrit, using an ADVIA120 hematology analyzer (Bayer, USA).

The data indicate the oligonucleotides did not cause any changes in hematologic parameters outside the expected range for antisense oligonucleotides at this dose. Specifically, treatment with ISIS 532401 was well tolerated in terms of the hematologic parameters of the monkeys.

C-Reactive Protein Level Analysis

To evaluate any inflammatory effect of ISIS oligonucleotides in cynomolgus monkeys, blood samples were taken for analysis. The monkeys were fasted overnight prior to blood collection. Approximately 1.5 mL of blood was collected from each animal and put into tubes without anticoagulant for serum separation. The tubes were kept at room temperature for a minimum of 90 min and then centrifuged at 3,000 rpm for 10 min at room temperature to obtain serum. C-reactive protein (CRP), which is synthesized in the liver and which serves as a marker of inflammation, was measured using a Toshiba 200FR NEO chemistry analyzer (Toshiba Co., Japan). The results indicate that treatment with ISIS 532401 did not cause inflammation in monkeys.

Example 137

Measurement of Viscosity of ISIS Antisense Oligonucleotides Targeting Human GHR

The viscosity of select antisense oligonucleotides from the study described in the Examples above was measured with the aim of screening out antisense oligonucleotides which have a viscosity more than 40 cP. Oligonucleotides having a viscosity greater than 40 cP would be too viscous to be administered to any subject.

ISIS oligonucleotides (32-35 mg) were weighed into a glass vial, 120 μL of water was added and the antisense oligonucleotide was dissolved into solution by heating the vial at 50° C. Part of (75 μL) the pre-heated sample was pipetted to a micro-viscometer (Cambridge). The temperature of the micro-viscometer was set to 25° C. and the viscosity of the sample was measured. Another part (20 μL) of the pre-heated sample was pipetted into 10 mL of water for UV reading at 260 nM at 85° C. (Cary UV instrument). The results are presented in Table 237 and indicate that all the antisense oligonucleotides solutions are optimal in their viscosity under the criterion stated above.

TABLE 237

Viscosity of ISIS antisense oligonucleotides targeting human GHR

| ISIS No. | Chemistry | Viscosity (cP) |
|---|---|---|
| 523723 | 5-10-5 MOE | 8 |
| 532254 | 5-10-5 MOE | 22 |
| 532401 | 5-10-5 MOE | 12 |
| 541767 | Deoxy, MOE and (S)-cEt | 13 |
| 541875 | Deoxy, MOE and (S)-cEt | 33 |
| 542112 | Deoxy, MOE and (S)-cEt | 10 |
| 542118 | Deoxy, MOE and (S)-cEt | 14 |
| 542185 | Deoxy, MOE and (S)-cEt | 17 |

Example 138

Effect of ISIS Oligonucleotides Conjugated with GalNAc3-7 vs. Unconjugated in a Mouse Model ISIS oligonucleotides targeting murine GHR and that were either unconjugated or conjugated with GalNAc3-7 were tested in BALB/c mice for efficacy and tolerability. BALB/c mice are a multipurpose mice model, frequently utilized for safety and efficacy testing.

The oligonucleotides are all 5-10-5 MOE gapmers, which are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the murine gene sequence. "Stop site" indicates the 3'-most nucleoside to which the gapmer is targeted human gene sequence. Each gapmer listed in the Tables below is targeted to murine GHR mRNA, designated herein as SEQ ID NO: 2333 (GENBANK Accession No. NM_010284.2). The oligonucleotides are described in detail in the Table below.

TABLE 238

ISIS antisense oligonucleotides targeting murine GHR and conjugated with GalNAc3-7 or unconjugated

| ISIS No. | Sequence | Conjugated | Target Start Site | SEQ ID NO |
|---|---|---|---|---|
| 563179 | TGCCAACTCACTTGGATGTC | No | 772 | 2334 |
| 739949 | TGCCAACTCACTTGGATGTC | Yes | 772 | 2334 |
| 563223 | GAGACTTTTCCTTGTACACA | No | 3230 | 2335 |
| 706937 | GAGACTTTTCCTTGTACACA | Yes | 3230 | 2335 |

Treatment

Two groups of seven-week old female BALB/c mice were injected subcutaneously for 4 weeks with 10 mg/kg/week, 25 mg/kg/week, or 50 mg/kg/week of ISIS 563223 or ISIS 563179. Two groups of seven-week old female BALB/c mice were injected subcutaneously for 4 weeks with 1 mg/kg/week, 5 mg/kg/week, or 10 mg/kg/week of ISIS 706937 or ISIS 739949. One group of female BALB/c mice was injected subcutaneously for 4 weeks with PBS. Mice were euthanized 48 hours after the last dose, and organs and plasma were harvested for further analysis.

Target Reduction

To evaluate the efficacy of the ISIS oligonucleotides, plasma IGF-1 levels and mRNA expression levels of IGF-1 and GHR in liver, as well as mRNA expression levels of GHR in fat and kidney tissues, were measured. The results are presented in the Tables below.

The results indicate that the GalNAc3-7-conjugated oligonucleotides, ISIS 706937 and ISIS 739949, are 7-8 times more potent than the parent oligonucleotides with the same sequence, ISIS 563223 and ISIS 563179, in reducing GHR liver mRNA levels and were 6- to 8-fold more potent in reducing liver and plasma IGF-1 levels. Expression of GHR levels in the kidney and fat tissues were not decreased with GalNAc3-7-conjugated oligonucleotides, since the GalNAc3-7 conjugate group targeted the oligonucleotide specifically to the liver. This loss in fat and kidney reduction with GalNAc3-7-conjugated oligonucleotides did not affect reduction of IGF-1.

TABLE 239

Liver mRNA expression levels (% inhibition) at week 4

|  | mg/kg/wk | GHR | $ED_{50}$ | IGF-1 | $ED_{50}$ |
|---|---|---|---|---|---|
| ISIS 563223 | 10 | 62 | 4.2 | 15 | 19.4 |
|  | 25 | 97 |  | 69 |  |
|  | 50 | 99 |  | 77 |  |

TABLE 239-continued

Liver mRNA expression levels (% inhibition) at week 4

|  | mg/kg/wk | GHR | $ED_{50}$ | IGF-1 | $ED_{50}$ |
|---|---|---|---|---|---|
| ISIS 706937 | 1 | 59 | 0.6 | 24 | 3.4 |
|  | 5 | 97 |  | 63 |  |
|  | 10 | 98 |  | 69 |  |
| ISIS 563179 | 10 | 50 | 9.6 | 22 | 49.4 |
|  | 25 | 67 |  | 31 |  |
|  | 50 | 93 |  | 50 |  |
| ISIS 739949 | 1 | 39 | 1.2 | 18 | 6.4 |
|  | 5 | 89 |  | 57 |  |
|  | 10 | 94 |  | 45 |  |

TABLE 240

Plasma IGF-1 levels (% inhibition) at week 4

|  | mg/kg/wk | Week 2 | Week 4 |
|---|---|---|---|
| PBS | — | 0 | 0 |
| ISIS 563223 | 10 | 13 | 22 |
|  | 25 | 40 | 60 |
|  | 50 | 43 | 71 |
| ISIS 706937 | 1 | 20 | 31 |
|  | 5 | 46 | 64 |
|  | 10 | 61 | 67 |
| ISIS 563179 | 10 | 19 | 25 |
|  | 25 | 10 | 24 |
|  | 50 | 25 | 46 |
| ISIS 739949 | 1 | 11 | 24 |
|  | 5 | 29 | 41 |
|  | 10 | 37 | 31 |

TABLE 241

GHR mRNA expression levels (% inhibition) in fat and kidney at week 4

|  | mg/kg/wk | Fat | Kidney |
|---|---|---|---|
| ISIS 563223 | 10 | 21 | 45 |
|  | 25 | 30 | 66 |
|  | 50 | 62 | 65 |
| ISIS 706937 | 1 | 0 | 5 |
|  | 5 | 0 | 0 |
|  | 10 | 0 | 14 |
| ISIS 563179 | 10 | 4 | 38 |
|  | 25 | 14 | 40 |
|  | 50 | 20 | 41 |
| ISIS 739949 | 1 | 4 | 11 |
|  | 5 | 0 | 1 |
|  | 10 | 0 | 8 |

Plasma Chemistry Markers

To evaluate the effect of ISIS oligonucleotides on liver and kidney function, plasma levels of transaminases, bilirubin, glucose, cholesterol, and triglycerides were measured using an automated clinical chemistry analyzer (Beckman Coulter AU480, Brea, Calif.). The results are presented in the Table below. None of the ISIS oligonucleotides caused changes in the levels of any of the liver or kidney function markers outside the expected range for antisense oligonucleotides. The GalNAc3-7-conjugated oligonucleotides had a slightly improved profile over the parent oligonucleotides.

TABLE 242

| | mg/kg/wk | ALT (IU/L) | AST (IU/L) | Bilirubin (mg/dL) | Glucose (mg/dL) | Cholesterol (mg/dL) | Triglycerides (mg/dL) |
|---|---|---|---|---|---|---|---|
| Plasma chemistry markers in BALB/c mice plasma at week 4 | | | | | | | |
| PBS | — | 26 | 58 | 0.2 | 165 | 70 | 123 |
| ISIS 563223 | 10 | 23 | 69 | 0.3 | 157 | 74 | 186 |
| | 25 | 39 | 91 | 0.3 | 165 | 62 | 160 |
| | 50 | 49 | 118 | 0.3 | 159 | 56 | 115 |
| ISIS 706937 | 1 | 25 | 62 | 0.2 | 152 | 64 | 167 |
| | 5 | 28 | 64 | 0.2 | 180 | 53 | 140 |
| | 10 | 27 | 65 | 0.2 | 165 | 56 | 133 |
| ISIS 563179 | 10 | 28 | 78 | 0.4 | 156 | 65 | 131 |
| | 25 | 28 | 95 | 0.2 | 152 | 59 | 118 |
| | 50 | 63 | 108 | 0.3 | 157 | 80 | 143 |
| ISIS 739949 | 1 | 24 | 66 | 0.2 | 156 | 66 | 114 |
| | 5 | 29 | 80 | 0.2 | 153 | 76 | 161 |
| | 10 | 31 | 59 | 0.3 | 174 | 78 | 155 |

The results taken together indicate that oligonucleotides targeting GHR mRNA expression when conjugated with GalNAc3-7 had tenfold greater potency and similar or improved tolerability profiles compared to the parent oligonucleotides.

Example 139

Tolerability Study of an ISIS Oligonucleotide Conjugated with GalNAc3-7 and Targeting Human GHR in Mice ISIS 766720 was designed with the same sequence as ISIS 532401, a potent and tolerable oligonucleotide targeting human GHR and described in the studies above. ISIS 766720 is a 5-10-5 MOE gapmer with mixed backbone chemistry and conjugated with GalNAc3-7. The chemical structure of ISIS 766720 without the GalNAc3-7 conjugate group is denoted as mCes mCes Aeo mCeo mCes Tds Tds Tds Gds Gds Gds Tds Gds Ads Ads Teo Aeo Ges mCes Ae (SEQ ID NO: 703) and is fully denoted as:

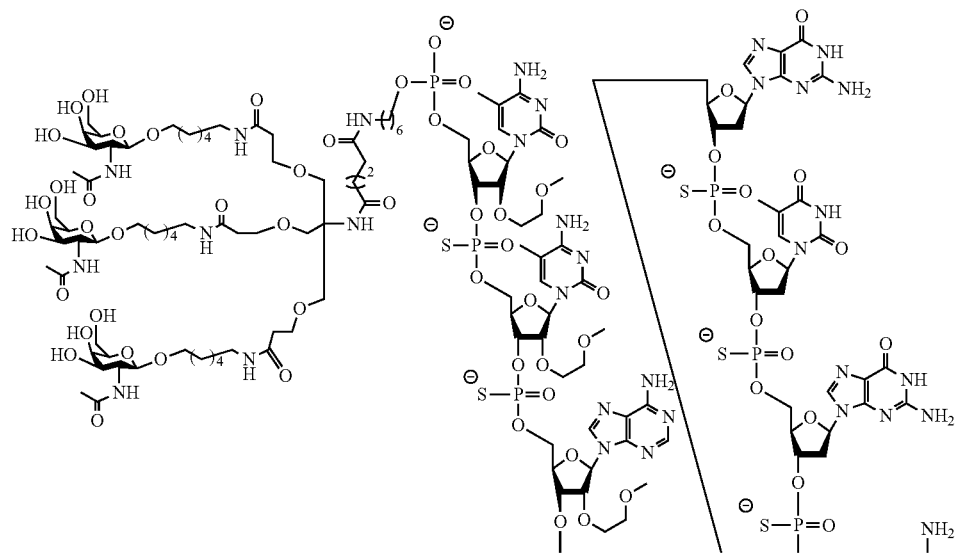

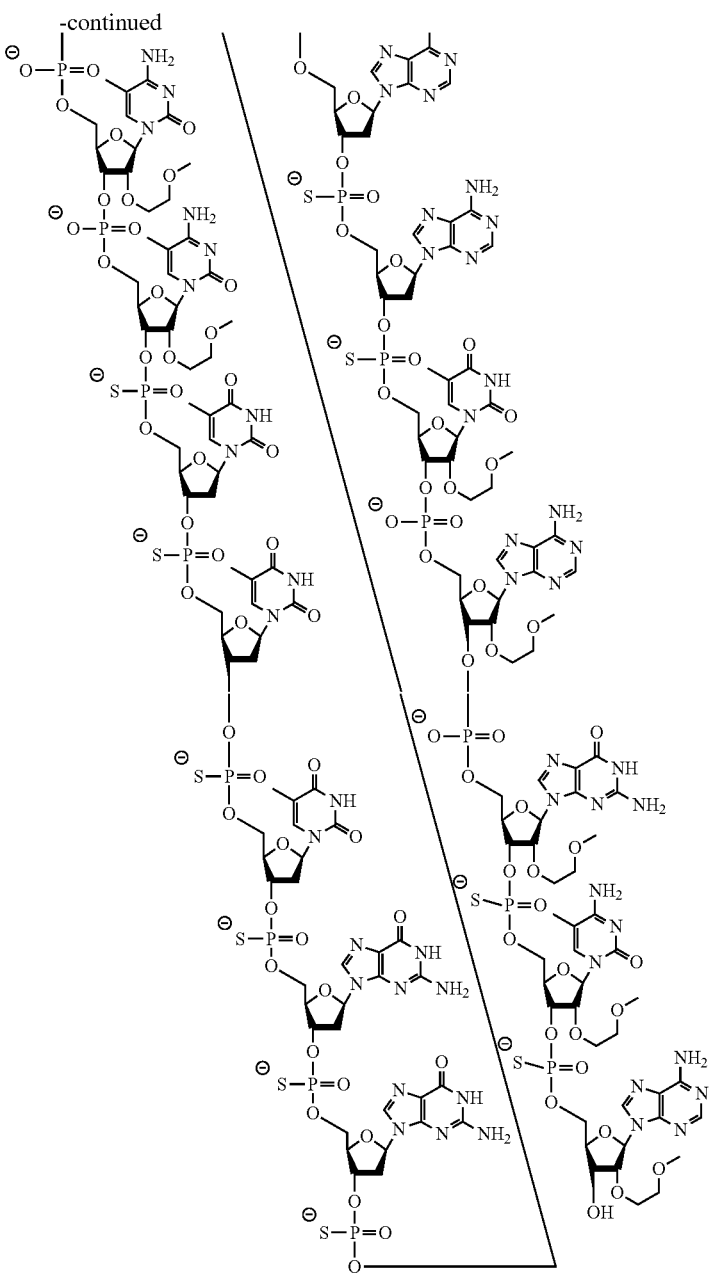

Treatment

Groups of six-week old male CD-1 mice were injected subcutaneously for 6 weeks with 25 mg/kg/week, 50 mg/kg/week, or 100 mg/kg/week of ISIS 766720. One group of mice was injected subcutaneously for 6 weeks (days 1, 5, 15, 22, 29, 36, and 43) with PBS. Mice were euthanized 48 hours after the last dose, and organs and plasma were harvested for further analysis.

Plasma Chemistry Markers

To evaluate the effect of ISIS 766720 on liver and kidney function, plasma levels of transaminases, bilirubin, creatinine and BUN were measured using an automated clinical chemistry analyzer (Hitachi Olympus AU400e, Melville, N.Y.). The results are presented in the Table below. ISIS 766720 did not cause changes in the levels of any of the liver or kidney function markers outside the expected range for antisense oligonucleotides and was deemed very tolerable.

TABLE 243

Plasma chemistry markers in CD-1 mice plasma at week 6

| | mg/kg/wk | ALT (IU/L) | AST (IU/L) | Bilirubin (mg/dL) | Creatinine (mg/dL) | BUN (mg/dL) |
|---|---|---|---|---|---|---|
| PBS | — | 44 | 79 | 0.3 | 0.2 | 29 |
| ISIS 766720 | 25 | 29 | 47 | 0.2 | 0.2 | 34 |
| | 50 | 38 | 56 | 0.2 | 0.2 | 35 |
| | 100 | 29 | 45 | 0.2 | 0.2 | 31 |

Body and Organ Weights

Body and organ weights were measured at the end of the study. The results are presented in the Table below. ISIS 766720 did not cause changes in weights outside the expected range for antisense oligonucleotides and was deemed very tolerable.

TABLE 244

Weights of CD-1 mice at week 6

| | mg/kg/wk | Body (g) | Liver (% body) | Kidney (% body) | Spleen (% body) |
|---|---|---|---|---|---|
| PBS | — | 40 | 3.0 | 1.0 | 0.2 |
| ISIS 766720 | 25 | 41 | 3.4 | 0.8 | 0.2 |
| | 50 | 41 | 3.3 | 0.8 | 0.2 |
| | 100 | 40 | 4.8 | 0.8 | 0.2 |

SEQUENCE LISTING (2336 sequences)

SEQ ID NO: 1 - DNA, 4563 bp, homo sapien
cggcggcggcggcggcagcggcagcagcagctgctacagtggcggtggcggcggcggctgctgctgagcccgggcggcggcggggaccccgggctggggccacgcgggccggaggccccggcaccattggccccagcgcagacgcgaacccgcgctctctgatcagaggcgaagctcggaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 2 - DNA, 303000 bp, homo sapien
gccatctactgagatggaaatgtcacccactgtgattggagtatgtttaaggagaaagaaccagagttcagatgtggacatgtcaagtttcagaggtctgttagacatccaaatggagatacccagttgttagcctggagctctgtggagagatctgggttagagatataaatccaagagatacaacttttcattcaatttgattatttattggacgctttataaactctgtaaatactgggcactaacctagacattgcaggtacagatattaagaatatatagtttctccctcagaaatctcttaattaatgagaaaagcagacatgtcaacaaaactgcaatatttaataaaagaagatataaaggcctataaaggtgctgatacagggagaattaattaattccaccctggggaatagtcaggaagaccttcagagagaaagtaaacaattgattggaactttaagattaagaaggatttctctgggtggacaaagtaggatcttccaagcagagtggaaaccatgagcaaatgcagtttcattcttcagaaggtaaatgtgctctggcatgccttaacttataacaaattaatcaactcaatacctgctacattttccctcacaatttggaatatataaagaggcacatactactatggaccaatacctggtcatatatgagattgaaggacctttacttacgaggcttaaaaataaagactgcccttcatgtcagttgcaggtttatatctagttctatagtattaactgaggtgtcttttcctatgttttctgtgcatgatgactttttaaaaatcaaagacagagcagcagccagagtagtctagtttcatggcacacagaatggaggatattgctgaacccagatttaaaaaaaaaaagaagtcaattcttatttttttaagtatggccctgagctcatctcagagcataaacaatagaatttagaatatcttttatgactccgtctggcacctcctaaactagatcaagattctctagctcagggaagaagggcaaaggatgagaaggcacagagaggatataaacagagaggttggtagtgccaggctctgaagaaggtccaacttggaaggtcatttcagacaggcgtggagtcagcatttgaggcctgtctggtctctactcctgccaggactaccctgtcagccagcttggcaggtatggaccacccagcaggagtttttcttgactgtgccctaatcttttactttcccaagtttctctatatgggtacctccccttttaaaagctccagacacagccaagcaccactattgctccagcaaagtatgaagccccagaaatcaatggtttggggaagagtcttaggggaactaaatgcctccttatttttagatgccatagaacaagagcagttcaggatcaataaccatcccaccccatgataaaacacgccccttccagaatctttcctttttcgttcattctaggtgtctgtctggaacagctggggtatttgagccacagctgagcttctgaaagcattctaaggaacagtttttcacttatctgattcctttgaaaataggggtatcttatgtgatatctgctatcccagagtctttggtcctctgttccttctcaagtcttggctcccgtgtactacttcaaagccctatagatattttattctaaagaaaagaaacttggttcctttaagttgtttaaacatttctttctgggtataaacttgggtttgtgtctgggagctctgttaaaaaaaaaaagtctttagtaagccaaagctgttagaagcttataagtaagtgacattacaattgaccgtcagtaaatagtggaaagattgcatgactagctactccttcagatctgagacaacctggagctagatttttgtactctctactcagaaaagcatatagtgacttggggtttgatgctgtacaaaaatgacatgcttatgcacaactttaactttctgcaacacttttacaacttcttgtgaatgaagtaggcagggctcgcatttgacagatgagctatgtccagcgtgaggcagagttaaaacccttttcctggctcaggaacttcaggctggggcctgtgtctgctctccctgcatccctgtcctctagcagatacctctctgctaacatgctgagtgtccttggtaaattactcattctctctgtctccgtcttctaacctccacaataaagtccttcgtagttttaactatcttttcactgtgccccagtgagcaggagtttggaacttgattgttgatggaaaggcaatatttggatggctaaacacgctttccaaggtatctcgctgatcttcctctcattcctggagatagctaacctttttgtaagtgtttctttgagtctgtggactgcacttaacgctcttgtaggtcctgctttcatttggaacgggcaggcggagaggaaggaagtgtattgcaactaccaatattttcctctaggaggagccgcgcagctcagttgagagtgacacgcaccaactccagctcctcgccgggaagacttcatcccagcaactcggaatgcttggcccgggcggcactcggcctctccgcagcagttctcgaactggcctccttgaacgtccgcttcgccttcgcttctgcaacctggatctgggggactgcgggccaggcgcggcgtgacccctggtgaacggtggccgccttttcccacccctgccctcccatcctcccttcccgtttcaccccgccccctctctcctccccaagcctgacagcccgcgagctgccaagcagggcgcagccatgggaagaggaggagggctagggagcggcggcggcggcggcagcggcagcagcagctgctacagtggcggtggcggcggcggctgctgctgagcccgggcggcggcggggaccccgggctggggccacgcgggccggaggccccggcaccattggccccagcgcagacgcgaacccgcgctctctgatcagaggcgaagctcggaggtactggagtggggctccgggagtctggctttattttcctcctgttgtgccagggggcctgagggtgaaccctgggactctagttgtttatgaaaacgggaggatctgtcttatatatttacacggataattttttattccggatgacttggctgtgctcccctcctccttgcgaagaagttgttttctgctggtgggttgttgtaacccaatctagtgtgtgtgtgtgtgtgtgtgtgtgtgtgtgtgtgtgtgtgtgtgtgtctggaagttggtgagggcggcagggagttgcgggcgacagacgaaccatcacactctggcgtctgctctggcccgcgagtagtgtacgtggaggggtttactccggagacagttttgttaaagtcataaaagttttgctagtgtgtttctgtttgccatcatctgcctggctgcggcaggaactgccgaggctgctgctgttgcgcggggaagaatccccggcagcgcgactggagagactggggaggtcgagctgtgcgcgtggacacagcgcgcagagcgcgcggtcttttgcgcgtttgtgcgggccgcagccgcacgttggcaccgatggaactggggtcagtagagtgacagccaccagtccgcatgaactggggtaagtggaaattgtggcgagccgacctcccccagcttttgacacactagtggttgtaaaatcaaccaggcttaaagttttgacagaactgccagaggctgcgggtcaatggggtggccgcgtgtctagggagagggcgctggcggcgcagagggtgcggggcagggcacttgcgagtgcgtggggaagtctatttggggcgagtgctttatatatagcccgaggggatgcctgctgagaccgagctgcgggggctctcggtctggcgcggactgtgtgtcctgaatgagtgtacgtgtgcgctgtgtgtgcgcgcgcgagtgtgcgcctggggaggcgtgtcggcgcctgagccagtagggtgtgcagggtggaagaggccacagaggtgccgcctgtctgtttgtgccgccaggagaccttggaagggacagagaaaggtaacggaaggccaaagtgttgggaagtcagagtagtttctgcataggattaagtattaagggctttaaaataactaaacgcattgccctgagtggctgaggactggaagtgaggttttggggagttctcaggagaactgcatgggagggcgtttgggaggtctaagggatgtgtaatatgtgtgagtacagaacttcggagacagacacaggttggagctatgaatttgaaattttcagggtgctgctgtccacagtccagggactggctggtttcagaggtattcaggctccctggtgtgtgtgcctgggaagacactcatcttttcttgcagacatgggatattgtggcaggtcaggctctgtttcctgagcaactggtgttccaggctagtttccacctgaatcaccctagaagtgtcttttttctgatgataaatgttgaaacctttccagaaattaaaatgctggatagaaacaaaattgatgcagcagacaggattgttgattctatttattcagtgattgggagctctttttccttttgagaaaagcaaagctcagtgtttccagattagatttcaaggagtcttcagctatctacagcttcccttctgggcctttggatggagctggaaggatgtgttttggcctaaagacctttggaagacatcatgtgtagcttaaagaggttgtcccgtctctcatcatcttcttccacccttataaactttttgttttgcattaatctaaggaaagttggtgtgtcaacatttagcttttttttattggagtaaatatatcacagtgaaattatagttatggtctcctgaagcccatggaaagccaacacttaatgggcaaaggtgtgaaatgaaagtctataaatgcaatgacaaagtgacgagatgagtgcattcttttttcaaaatgaacataactgtgctcacaaaaatttgttttagccaggctttgggcccatgttttttattattagtttttaaacagcagactccacatcataaaccactttaaaatggatactagaggcctcctgtatgctatctctggcgcctgcttaaacagatgtttacagtgcttggtaacctatgggattgtcatgttgagtatcttgttagctcaggacataatgtttatagcataatataataaatggagccacagttgcagcgtgcttcttccaagtgcatgaagcaaatcttgcagcagggaaacaaatcttgcagttggtccaacttggctagccttctttggctatctcctggtgagcaatgttaatgtaaagataaatgtgagtgacgtagtgagaaagtgggacagtaaattgtttagcttagtgaaaaaagcatggattatgttttttaaatctgctaacctgaagattacacttctcaggtcgtaccactggcaaattgcacaactatgggaatttggtttgcttttaaagagcaatttttaaaaagtatgtcagtaatgaaaataacttatatttcttaatgtgtttatgtgtgtccatacaagccaatactttttcttctttaaaaagaaccctataatttctgtggtaattatttaaatattatgagcattcaaatctcctaatcaccttttcaatcttcaattgataagaatcgaagtttggtaagactggagtcatccctcagccaattgtgtaaacaagacagtacagaatgtctttctggcaagtaatttttttcaacctgaaacagataatataaataatatgtcccataaaagaattacttaagatgataattactttagaggtaattatctggtgcatgaacctctatctgtgaaaatggtctagtctatctcttattggaaataatcagttggaaatctccctttttcattggtcagtccattctaggaaagattcatttctagaaagttcttatactgaatcaacattttcttccatccacttgcctatccttcagcagctgaccacaatgaatctagtctcttttccctgtgtttaccatacttgaaaacaaatattatcctccttgccgaatccccttttgcctactcttggagcagtttttcatccactatagggttccaccctcctctgccttgaacaagatgcccttgattgtacattctcattgtattagtctgttctcatgctgctaataaagacatacgtgagactgtgtaatttataaagaaaaagaggtttaatggattcacagttccacatggctggggaggcctcacaatcatggcggaaggtgaaggaggagcaaaggcatgtcttacatgacagcaggcaagaaagcatgtgcaggggaactgccctttatagaaccatcagatctcattagacttattcactatcatgagaacaacatgggaaaaacccacttccatgatttaatcaactcctactgggtcccttccaccacatgtgggaattatgggaactacaattcaagatggcatttgggtggagacaaagccaaaccatatcattccgctcctagcccctcctaaatctcatgttctcacatttcaaaaccaatcataccttcccaacagtcccccaaagtcttaactcatttcagcattaactcaaaaatccacagtccaaagtctcacctgaaccaaggcaagtcccttccacctatgagcctgtaaaatcaaaagcaagttagttactttctagatacaatggaggtacaggcattgtgtaaatatgcccattccaaatgggagaaattggccaaaacagaggggctataggtgcaagtccaaagtctaatagggcagtcattaaaccttaaagttctgaaatgaactcctttgacttcatgtctcacatccaggctgttttcatggctggcattgactgtggcttttccaggcacatggtgctaactgtcagcccctaccattgggggtgctggggaatggtggccctcttctcttagctctactaggcagtgacccactggggactctgtgtagaggatccaaccccacatttcttttcctcattgccctagcaagggttgtttatgagggctctgcccctgcaggacaactctgcctggacatccaggcatttccatacatcctctgaaatctaggtggaagttcccaaacctcagttcttgtcttctgtgcacctgcaggaccaacaccacatggaagcttccaagacttggggctttcaccctttgcagccatggcctgagctgtaccttggccccttttagacatggctagaggggctgggacacagggtaccaagtacctaggctgcacctagcaggcccagaaaaccatttttccctcgtaggcctctgggcctgtgatgtgaggggctgccataaaggcctctgacatgttctggagacattttccctattgtcttggtgaccaacatttggcttctcattacttatgcaaatttctgcagcagtcttgaatttctccccagaaaatgggtttttcttttctatggcatcatcagcttgcacattttccaaacttttatgctcttttcacctcttgaatgctttgctgcttctaaatttcttctgccagataccctaaataatctctctcaagtttaaagttccacagatctctaggacaggggaaaaatgccaccagtctctttgctaaagcattaacaagagtcacctttgctccagttcccaacaagttcttcatcttcatctgagaccacatcagcctggactttattgtccatatcactataagcattttggtcaaagccattcaacaagtctctaggaagttccaaactttcccacatcttcctgttttctgagccctccaagtctctagaaagttccaaactttcccacattttcctgtcttcttttgagccctccatactgttcaaacctctgcctgttacccagttctaaagttgcttccacatttttgggtatctttacagcagcaccaactctaccattaccaacttactatattagcccattctcatgctgctaacaaagacatacccaagactgggtaatttataaagaaaattaggtttaatggtcgcacagttccacatggctgggaggcctctcaatcatggcagaaggtgaaggaggaataaggcactcttacatggtggcagacaataaggcatgtgcgggggaactaccctttataaaaccatcacatctcatgagacttaatcactatcgcaagaacagcatgggaaaaactcgccctcttggttcaatgacctcccactgggttcctcccatgacacatggggattatggtagctacaattcaagatgaaattggggtggggacacagcaaaaccatattactgactgtccctcctaatgtgtgttttctaaacaaaagatttataatttgtagttctgaacattctatatctattaagacagtttaatattaatgaaattctttagccatttcattacgctcttgattaatttcatacctataaacaagataacttgttcttttcagattattaatcatccatagtcaaagcatttttataatagcttcaaaacattttttcatgcctgaatgtactataaatttatggaaagtataatactgtgtgggtaaataaaattctataaacagtgcaaatagtgacttaatttctccctatcaaggaatatcaaccccaaatataccgaaagtagaatgttccaaagataaacaagttgaaactacatgttatagacaggtagggactatgatgtatttttttcataggcctcattgtgtctgcttccatgaacatgagtcagtactagcaatcaggcatttattgaaggcttgttctgccaaagtcccagagagtatgccatctggccttaaatgaagtgaaagtacatcaaataaagatacttccttgggcaactgggatttaagatgtgcatgcaggacatgtctaagtcagccatctactttttctcaggaggtaaatggcttgccaatgccacaggaaagtctaaagtgttcacactccataagcaggtcccatgtcctgttgtaggtctggacaggagctggacaaaggccctgttactcttagcttaccaagtcttagctgccttggaagaagatagcaaatctggcttatccagaggagaggcctgaagtgtgcattgggcacctacctggtgtgactgatttctcttttatgtatctgtcttgggcttccagctaaattgtgaattccccttgccaccaagctaagaatctgccacagcattgtcttcctgcacacacacacacatacacacacacaaaaacatatatgttggatgatgaagagacaatgtcagtttttcagcaagtctgaatgtgaaacaaatggctatgtttcttggtgcagtggggtgggaggatgagagagaaaaaacaaacctgtgatataaactgacatctgagcctaccaaaagccctttgagagacctttgatcaagacaaggggataatcatagtgttgtgcacttagataaaattgtccatgctagtcccgtgtgtgtgtgtgtgtgtgtgtgtgtgtgtatgtgtgtgtttcttcactttatccccagcattatggtctcaattcatacacatttgcttttttgctttattctagtctgatatgaagggaagaaataagcaatgattcagttcctttttttacatttcaaacattcatttcactactccccacctcccagtcctcaccccccaaaattacaagagacccattggcaagtacttggacatgcaattttcaaaccaaaggtttactttgctataagaaacgtctaagttaggatgatataatatgaaataatagtaaattagatgtcaagaaacttgggtcctctccaagctctgcctttaatgggctttgcagtttttgccaactatttaaccttcctgggcttcatatttcttgtatgttaaaaacaagcaaaaaggagaagtaaacaaaatgaccccttagaattctcttcagggctattgtttgaatccatttaattatcaaatttctctcttcttttaaatgtaagcatcaaaaaatgtttgcctattttattctctcatcattaatttttaatcaattaaataaaatagataaaaattttatcaaaaccatgcttcttgctttcattctaaaacaatgcaactcatcactatctgatgcagaaagtctttctgaaatattgtttttctcttttgttgttgtttttttctttgtgctaaagaaaattcattgatgagtaccaggttcttcaaagaaggatggaaaagtcattgttttttagtctcaacttctttcttcagtgcttcttcctaccttttaatataggcaaataaagccttaggccaggcactaattttacttagtaatgattcataagaaggtagtgattttgtcagaaattgctggctgcatgcttttaatcagcatctaaacttaccttcaaatactccattccaaaatcagcagataacttcttctacagagtctttcaaacttccagatgtgtttactgttttgattagggctttcttcttttgttgttgataagacttcagccagttttctttaggctaacattattatattcccaatgaattatacttcttaggttgtgaatttgtttaaagataaatctatctccagctggctggcttctaagtaaaaaggggtatcctagggaagaagtgcacttcacagggattcagtacaggtgtagagaattccctgatagagaattggaacacatcaagagtttgcaaattgaaaaggtacttttatgtacttatccatggtggacaacctgtgtcctagggaagaagcgcatttcacagggattcagcacaggtgtagagaattccctgatagggaactggaacacatcaagattttgcaatctgaacaggtacttttatgtacttatccatggttgacaacctactgtgctagacatttgctgtagtaactccttgattttttcctcggttgtttataaaattaaacatttgaagtagcctattgaaaagtcttaaaagaagcatctcctctattcctttagaatacagtatattaaacaagtgataaagtccaaagaaaaatccttattcttttcttgctttaaaaaatgcactttattttattaagcattatatctatcttttaaaactttgaattgccatatcaatgaaagtagagtgttatcattacaaaacagaatcgcagatagttctttccctgtgcttattgagagaaaaggtgcataattgatgctgtaaatgatcatcttgaatttgatgatggctggtgagaaacctcagtcagacattcaattttgattgccattggtcagaaaggcagcctttgttcttcgtcactatgtggcacatgatcctaattcaccctatcagctgcttctctgcacactttcaagctatgtgattgttatactagaaagcctctaagttggccaaactaatgaagactaatctgacaaagcatatgtgaatgataaattctgtaaagaccgtggagatagagcctctgcagtggcttcttcccctggggatagaagaagataccagaatccctgggcaagatgaaatagataaaggaaaggcatcatttttatacctaggaaatcagaaagattaaagaaagagaagcaagaataaagaagaactactactttcatagttcattctttcaatgtagcaccttatttcccatagagacattggtgaagccatgcttttctttgccatagaataggtgttcagtaaatattttgcaggtggccttaatatgtagtaaaacatacagaaatatggaagcattgacaagaagtttgtggataatttgagggcaaaaggatgtagataggatcaggttcataatgcaaatttgctattattctccttagattaatgatgtcactcaaacttcatgacctgctttccaaggtgtatgctgttcacagccttggaaacatttagaagtttttagtacttggagcaagatggatatatgtttcacattttatctaggacttagtaggacttgggagacatatctactttgccagatcttagtatacttattatggagcatgacattttaattctctttgcttttgtcctacaaagtttagtgttttaatttatttttctcggtgcatatagggagagaattatttatataatctgaaaagtactttgaaaactacttgggaaaatatgttgaataaataagtttttttttaaattagcctacaggatgtaagtctggccaggctagtggtatttttggtatcattgtgaaaaatcaaaaacagaacatgtatttatcaatccattagtgtgttcccaggaatgtgctagacactagggaattaaaacatgactcttgactttagtaccaagcattcaagctagaaggcaacactattaatgtacattcatggtgtgattatggaacagtcgatgactgtacaacttaatgaaaagttcattagagactataaatgctacatttatttagagagaaggacaatctgtttggactgagggattggaagagtggccttcatgggcaacatggctcctgagccagtacttaagatatggtattttttttttttttttttttttttggttaggtagaagggttggagaggtttcatgcaaggagttaggaactgaggaccaggaggcgtatcttgagttcactggggttactggtaatagggaggaggcagagagtaccaggctgtggatttgttatccgttggaagctcttcccattgcttattatggtcgctgcatataggctcatcccttgggtagggctattggagtggccaccctgaccctattgctgattggatagtggtggctgctgtgtggtatttcagcacatttatcttttctgaacattatgtaaattcagtctgaaaacttctttcttaaacaatgttccaagaggcctattaaagatgccaacaatatgacttccattcaagaatatgatcttgaatgggctttacaatggcagagctgacctgagattacctcctctgctcctgctctcaagccatgtgctgatgctgacagtcctggcccaatagagccatagggcctcacagaacttgagatcatctaccagtggctgtcaaccaagccactcctttctgctaggtagtgcatagggacattgggaaatacagttattataagaactggaaagagttgtaggcttttggtgcctgaagtcagaaatgctaaatttctgtgatgccaggggcagtcctatataagaaattattgtgcctcctcaaatgccagtagatccctattgaaatacttgagtctcatatcctcactttatttataggtgaggaaatgggaggccctgagaagtgacaaaactttcttctaggattaaacttcacagtctcagtgacagatttataactcaattcttttagttttctttcaagagctcttgttgcagcaccacagtccctcctattaacatgggctataactatggaatagcatgttgtttatctctgccatttttatagaaggatgatagttagctatgttaactatctgaatgggtggaatgtgaattgagataactggtacttgaccagcagttctttcgcctgggaacacacacagattcacctgtaaattagggttggcagatgcctgttgagatgtcaaccatagccaaagcttacaaattggttgactttttggaaagggcatggagtaggctttggattcacacaaatctgcttgtctgaccggatttgaatacaacccttcttatctttactatctttgtgactctcagccaattaaactctctgagctttatctgcaaaaaaacagttgattattcttatttcacaagcaatgagtcaaaatagtgcctggcacatattgggcactgcagatatagagaattccctacagtatctttttgagcataaagacttgaaaccttcacttataaaagaccctcttgataacagtcgctatttttttctcctcctttccccaaacaacgaaactagggcttcagtgagtccctgaagtgtttactttgtttgaactgttgagatttccctcctccagaagagtcctgctggccagagatgagttccttttgacttctctgtcaacgtgcctgtattattgtcacatagtaaaaatgaaagatatatctagatgattattagcaggttatgaaacttagattttaaagtcaataataaaagccattcctgggtagagaagtttttcagagagatttctaccttgccagcgatgagagagcctacttaggtgaggtgaatactttaggcaagttaagggataacacaatataatttatttaagtaagttttttatctgggactaatttcaggtttgcagaaaagttgcaaaaattttagaggtcctgtatattcctcacctagtttcccatgttgacatccataatcatgatatatttgtcaacactaagaaaccaatgttagtacagtactattaactaaaatccagacttcatcctaattcccccagagcttccactcacatcttcttttctgttccaggattcaatccagaagcgtgcactgcttttgattttatgatttttaaatactgtgcatgtgcttttttaatttgggccctctcatgtgttaaacttaccggcctttgtaaccagatagcaagttctgtaacagaaaatacaatgatgttgaatccaacatcatgctgggcacaaagtatgttctccaaactaattaaatttatcacagcaacaagaacaaagttttactcagcgtacatatgtagctgagtcctcattggtaagctaagaggtagtcataagagtgggataacttggaagaaatttgattttgaatgtgtgccctgaacattggtataaaacaggaccccctaaatcatatatgaactgagtctgtacactgtgcctagcattgtgtgtgcatatcacacttactcctgataactgtaaggcacatagccttgagtaacttagctgaggaaatgagaccaagggaagttaagttacttggccagggattcacagctagtaacacagctgagattaaaacatatgtttttctggcttcagagcctacactcctaatgctgtattcaattactcccacacttctccacttgcttaacccctattcttggtgtcctttttctaggtatacagaatttgaaaactatattgtcaaactacagcagacctggatgcatggtatacacttctttgtgagctggattaagtttcagccttgaatttgtggattattttcaaaacctgcctaacatctgtaaaacatgttgtttttttaatatgtagatatccacataaattgaccacaatgctcttcagaaagtcccataatccaataataaataaatttttgatacatggctaataacaggcacagaagcatctccaaaggacaggacattgatattgtgtaataatttaaagtattttatgattgtataatgtgcctgagttttggatagttgacctctatttctcagtctttacatagttactgcttttttaagtgttacatgagggatgtggaatattcagtgtaacatttgactaatctttatgttttgagtggcccaactgaaaattacccttggttgccttggaactctgggcatgatgttcaaaactagaaattcttgcaaattatttgagctttggctctgggaagataaacaacatgaataactaggttaaccagggctgaaatttctctaacctataattctaaattcagaaaagaatgggctttagggttttttgtttatttttgctttgattacaagttgttggaagcctagagttagtatctaataacacaatctatgtaaaacacaaattattggctcagaatgatatctaatttctaagaagatatgaggaggcaatcatgtaaaaacgtgcttttcttcctagaaggaataagctgggattggccaaaaggtaatccctttagagtctaatgtttagagcattgcatatttttaaagaagacatattaccttttagaacatatgtaggaaaccattttctttgcttatatggctacataaagttgtcatggttttaaaccgtgaccttagataccttatagaagtaattacaggcacaatctgtgaatgaagatttgcaaactatgcttcaccaagcctcagggactattggatgtccagaggacagagccatgttggatgtcttatgggccttcagtcctgcaaagtggtgtgctttcatgttttacacacagcagttctgagaaaatttaagttgaaaaaacagcctctcttcttattatttttatatttatttatttatttatttatttatttatttatttgaaacgaaatcttgctgtgtcaccaggctggagtgcagtggcgtgaacttggctcactgcaacctctgcctcccaggttcaagcgattctcttgcctctgcctcctgagtaggtgggactacaggtgcaggccaccacgcccagctaatttttgtatatatgtatttttaatagagacagggtttagccaggttgcccaggctgatcttgaactcctgagctcaagtgatcagcccacctcagcctctccaagtgctgggattacaggtgtgaggcaccgtgccgagccatcctgtcttctgaaaaaaaaaaaaaagcaaacaaaaatgtttaagcctggtatatattttcttatattgcataagctacttttctgactgcctctctttagaaattcctctgatttctagagaaaaaaaaatcgcattagctttttggtttctaaattcaggctcactttagtaactgctagattataaactcttagaaggcaaagggctatgtattctctacttgtggacactcaattagtttgcttaagcaattacttctgtgtaagcaacattaatgaagtgcttactatgatcaagggctataccaagtccttttttatattatttaatcccacacaaaacccatgatcgacctaattgtacacttggtgaaactatgatgtagggaggttaaataatttgttcaagaacccacagctggtaagtcgcacagtgtattcaaacccagatcttcctaattgcaaatgtgtccaactcccatgcttctaaccactgcctatgtgatggttctttgaaattcctccctccaagaagtggaatttaattccccccgtccattgaatgtgggccaaactcaggtgactcatttctattaaatggagtaaagtggaagtgaagatgtgtggctttagcgactaggtcattcaaagtggctcctgtcttggttgttctgtctcttatacctattgggcatttaatctggggaaaaccagctgccatgttttgagctgctctgtggaaaggctaacatgaaaagatactgtggatcctacagacagcttcaaatgaggacctgaggccctcagaccagtagccagtatgaaactgaagcctcttgaccacagcctccatgagagtaatggaatcttgaccccctagtgaaccacagcctccatgagagtaaaattcaagatggagccttgacacccagtggagcctcgagatgactgcagtcttccaccaacagcttgattcatgaaagaccatcagccagagccacccagctaaggtgattctaggcccctactcctagaaaataaatatttgctgttttgactgccaagtgtttgattaatttgttacgcagcaatagataaataatgcagcctaacactgtcctggtcatttttaaaaaagaaattgttttaattttactaaatcacaaattttaaaacattgatacagcaaggagaaactttccagaaaaaaaatgctgccaaatttaagtagtaaaatattaatgtccaaaaaacatcatagttacaatgacatctctaggattgaggattttgtaagtcaaaggtcagctgcttaaaaaacccataattttaaaaggaaggatattaataataactgcattattgaacatagatagcattttgaacttttaagaaatcctcatgggaaaactcaggaaataatctgtttggtaagttatcactcataatcttaaattgttaggtgcatgtttgcactttccatgatttgaagaggaatataaagcaaagttgaattttaacctcttccctaatgattttactcagcttttcaaaggggtcctaaaagctcagaggtcaagtcatttcttggtttgctctacctgacaaattgcattaactctgctttatagccacttgcagtttaataaatgacttggactttgattaatatctttagtgcttaagcccaagaatttgtataagactttgggatatagtactgtaaatttatctaaagatggacactggaaggtagaaggagatatattagtgttggtttgggtacatgtctaggtactgaatttggatcatcataagtccttacagaagatacttgttgacttgtcttttaaaaaatatgtgaaagtgattttttaatatatttacaaagtgatctaagtgatttaaggaattcattcatgaagtggatatgactagttcttgtttagtattcagaatgactgtaaaatagaaatgctgattttccttgcccagattgtagaacacagatcaaaccctcctagtccttcccttaaatgttttttctccatacagcttatgccctgagttctcaaaacattttttatattgaactggactgtatagtatatgcctgaccctgattcatgggattatgctgcaagggaatataaagatgaatattgatagcctgagtgtgaaaattcatcattactctcatcctcattcattaattcatttgttcattaactcataaacacactaattgattcaacagatatttattgaacgtttacactttgcccagtggagcactggactaggtgctagcatagtataataagcaacccagaaatagcctctgccttgctgcatttcatagtctaggacggagaaaggcattaaccaagtataatttaaaattgttttaagtaatgtgaaataaacatatatgagaacttgactcaggttggtatatttgatggttagggaaagcttcaaaaatgggatatttgagatctaagtaagagggaaaagaaagagcataatgggtagagaaaaaataggatccaggaagatacttagtacttctgagaactaaaaacagtcaagtcagtgtagtcagagttcaaagaaggagaaagaacatgatccaagaagaagccagaaaagtaagcagggactacatcttacacgatgatgtaggctgtattttagtttttacttatcttaagagcaatagaaaaccattgaagggtttgaagcaggggagtgacataatcaggtctgcattttaaggaggtcacctgctctattatgaagcatgaatggaggaggatggaaagagatattcagggagctggtttatgagtctgttgtaggccagaggtattggtagcttggaccagggtgatgatgctgaagattgaaaggagttaatagatttataatatatttgtgaagtaaagttgactgtacttagtgctgacttagatagtactggtgagggatgtcatggtaaactccaaggtactgggcttcttcaactgagtggaaaacactagagggagaccaggtaaaggttgaaggaaagtgaggaacagtagttcagtttggggatattttgatttggaggcctttttaagacttcctcaaagagacacagtgcagtcttgagtcctggatcagaggagatacctcaatgtataaatttgtaagacaatggtttatacacactattaaagccactgaggtaagtgagatcatgtacagagtgaaaatgaagtgagagaagaaagcataagtctgagccatgagaactccaacatttaaaggccaagtggaaaagttgacaagagtgggaattgtgactggggtagatgctagaggggcatctcagaggccaaggaaagagaatcatttaaggtgctgatgaggggtaaagtaagaaggtcctgtaaatgtcctcttggattaataaatttgatgttttgaaggactttagggagaatgagtttgttgtagtgatgggggcagaagccagaatgaagtgtcatgggaaatgggtggaagtcttgaaagagagacaatgaatatagataactcaagatatgtggtcaagggaaacaaaaaggataaggctttaactagaggaggaaatggagttaaaggaggagtttttttttttttgagacggagtctcgccatgtcgcccaggctggagtgcagtggcacgatcttggctcactgcaagctccgcctcctgggttcacgccattctcctgcctcagcctcctgagtagctgggactacaggtgccctccaccacgcccagctaattttttatatttttagtagagacggggtttcaccgtgttagccaggatggtctcgatctcctgacctcatgattcgcctgccttggcctcccaaagtgctgggattacaggtgtgagccaccactcccagccaggaggagtattttttaaagatgggagacttgagcacatttgaacaataatggggaagaccagtggggaggatcaggggtggcctgaagatagacagagggtggataaataatcatgtaggattcctgagaagatagaagaagttggatccagagcacagcagggggaattagctggccttggagaggagagatgatctctatcctctattctagaaggaagccaaaggtgatgtgtgcagatgcagaggtgtgtttgatgtggtgaagccaagtcaaaggagtttttgttcgatgccttatatctgctccagaaagcagttgagtcaccaactgagacagggagagagaaaggggctggcatactaggaaggaaaggggatcatttcagatatttgaggaggacagagtaagttggaatatgaaagggaataaatgagtgaaatttagtaggactgctagtcactgcttgaaggctcagctgaggctgatgatcatgaattcatggtactactgttagaattattataaaatatatgagcctttttggaggtgctcagcagtttaccagacacagaaaaacaggttcatctaggcttaggattttgtcagagaggtatgatgaaaagattgcaaaggagtttaggatattggcatgggcaagggagcttctggagtgataaaccaggaatctaagcctgctagggagggacatatagacaggagaaggagagtatagagatctttctgaaggttagaggaaatttgtaatcaaagtggttgattaaacaagacagaagtatagcagtcagtgatcagcccaggatgctgcaccccagatcaattaaatctgtatttctgggtgtagggcccatcccagtttctcaggagattccagtgctttccttaagggagaatattgatataactgttattaagactattgtgaaaaaacatattagcaatgtgaaatcaagacaaaaacacaaacacagaaagaagttagacaaaaacaaaaaacactgaaattacacattttctttttcacaaatcaaagtcaaattcacggaccttcttccctgactcattctccctgacattagaagtccaaagggagcaagtaaagtctttatggggaagatggtataattaagcaccaattacctagggaccagatgctttgggatttgactgatgaaaacagattagaagcatggtgaatttgttcactactgtctttttggaggggcaacactcctggctcacttggcatgaggtaatgtcagtctggctacaaagatttgaatgtggggcttgagtttctaaaaggggactgattggacttctcttagccaggatacttggacttggtggctatatcatggctcacagtgtcttggaatggtcttgagcctagttgaaatttgttgaaattacatatgaatattcattaatgtattacttggaactcagtgagaaggatcatcactgccagatttcctagttaggaaaacttaccttcattccttccagttaaatagaagaccattgtatagttcattttgggctaagtggagtgtttatgaaatgtgtagggcttataggcataactattgctaaagaaagcccagtaaagcttgacatcccctctgttgcccttgtctgtcattccataaatttaatgtcaagggcatttttagagaagatgatcacaggatgattcaggtagacatggagcaggttgtgaaaacactggcatgtttcaccaatgtattagggtttccagagaaacaggaccagtagggtgtgtgtgtgtgtgtgtgtagatttattttaagagattggctcacacaattatggagactcgcaagttcaaaatgtgcaaagtgggctagtaggttggagacccagagaagagctcatgttgcaagtcaagtccaagtccgctgcagaatttccctttgcttgggaggtcagtctttggctctattaaggcattcaactgattggagggcagtttactttactcagagtacatcatttaaaattttaatatcatctaagaacactctcatagaaacatttagggtaatgtttgacaacatatctgggcaccatggcccagccaaggtgatatagatatagatatagatagatatagatatagatatagatatagatatagacatagacatagatagatatagatatagatatagataatggatatatataatggatatataatggttatataattaaacattacacctgggaagttacagcactatcttctctggattaaacaacaacaacaaaaatactcagtccaattcatgatttgttgagggtctgtgtagaatatagaaattatactacaagtttggttttctttaggatggtgagcattttataaaatatgtatatataaagagaggcattctcttgtaacacttagaatagtcctgtacacatagaaggcacacagaatgtccagtgccagtgacatgagacttcataatgagtttgaagccaaagctttgtgtagtaaaaagccatgagcagttaataaatttccatttgatggcagctataaatattaaccagaagactcataactgtgttttcaactcacatacctgggttggggcagaagcaatagtttcagcagcttttatttatctgcttttaattccatctcaccattgttaaatttacctgaaataattgccattttgacaatgccctcaaaaatcatcttattgcctggggactgattttcagattcctgagcccagtattcagaatcctatatattccctcaacctatctttccatgtgtattttctgttgagcttcaaactgaactacctctttgctctcaacatattctatttgttaacttttgttcatgttattccctctaaaatgacttttctctaatttttttcattctctcattcttcttgtctttcgaggtggaactcaaatgccacaacgtcaaatgccacagtatctgctatgatccttcccctttccagctacaaattcctctttcctctaccacttctttggcacatttattaagactcgcgatttctctcatctaagtctcttgtgcaatgtcttactgtatgtggcctgaattcaggatctatgtctacagcctcccctttagcctcactccagtatcttgcaggtgggcagtcctctgtaaacacttgttaaaaaagtcaaaacacatttttcaaatcagaaagaacctaacatacaaagcctcattgtcatttttaaatttcatcgaagagctatacattgaattttttgtgtgttctctatagtacctagccatgtgctggacagtggacccacagtggacattcagtaattagtaatagatggatttattctgtatttaacaaaattttctggatgcttttagactgaaggagattggtttgatgacacaagtttcaaaagacaatgttattgctaatgcacattatgagggaactatgatatattttgaagtccaacaaatagaaaaatgaatcaatcacgagtcagatttattgatggaattgtgccaccatcaagtcctaaagcattagtagtgatgttatcagaaaatatcccactctgagatcatctgtagccagctttatactctaaaagaatagtctgagtatgttctgcctggaaaagggctcagtggtctaggaattattgtttttactttttcaaagtttataaacttggcatgactgtgcttttctgtggcttccaatctctggtgataagttttctcaaaatattcctgatttatcctgatgtaaatcacaattcataaatatcaagagagactgcctacagtaccatcttctgatttaaaaacacatttgaatcaatatttacttatatataatgcattctgctgaataaggaagttctgacttgttaagctcagtatgcttcgataagaaagcaaaatttttttgttgggtttttaaaatgtattttaaggtccttgtctcttggtgatagttctttacatattgaagtgccagggaataactgtccagtagctggacaagagagactcataatatggcagttgaagccaaagcattaagcaaaaacagttattaatattaacaggctcactgtagagagaagccatagttgtcaggggaggcagaactgcccaggaaacccatctttgtccttttgtctacacaggttggggcaaaagcagcagttatttgaactcagcaaacctgtgttccatattgaaggcctgcataagtcagggaccagggatgtaatgaagaccagacatggactttaggagcacaaagtgtagagataaaactgcactcataatgtaagctaatgggaggcaggaacgatggaagcagcaaagactcgctacagtgggaggagttatgagagacttcccagaagatatggcatctgagctgattcttaaaagttctgtaagaggccaacaggcagagaaaaaatgaaaaaatgctattaaacagtatagcccataaccgtggggatataccagaggatgatgtgttagggaaatggtaagtactttaaagtggctagatcagagaatgttcgagggcaggtgaagggaaaagtaggcagggttcttatatttatatcagtgatcttggactttgtctggggacctgcaggtagctgctaccagaatttcttatgtcagtaagtaacatgatcagatttgttattttagcaagacaacttacactataaagtatagagaggtgtttggagtgcactgattgaacagtagtgtggagatgtgttttttaataataaaccaaatgagtaataacatgtcttactcttacataattagtaagatcttgccagcatctttgttggatgaaaggaagcctagtgtttatcaccaaatcttttgagatgtcagtataacacaacactgtattccacttttgaaaacagccatccctatagtgtgtgaagagaatacttaaagtgcagacagacaagtgaacaccgcacttctttgtcacatgcagtcaagaaaccagacaagatatttaagctatgattattagtgttggcaagggttcagctccagggaaaataaatacattgagttagtggtggtgatgagattgacacgaatagagttgtattttccttttcatgctgttgcaagggaaatgaagctttaaacataatgaaattggttcttgtgaacagcaaatctgctatttcttcactttttatggctttgtcaacagtgatctaagttttgctttacttatttattttaaattttgttttattttaatagtttttggggaagaggtggtttttggttccacgaataagttctttagcggtgatgtctaagattgtggtgcacccatcacccaagcagtatacactgtacccagtgtgtagtcttttatccttcaccccctcccacccttctccctgagttgccaaagtctattatattattcttatgactttgcatcctcagagcttagttcccacttacaagtgagaacatacaatatttggttttccattcctgagttactttcagctccatccgggttgctgcaaatgccattattttgttcgtttttatggctgagtagtattccatggtatatatatatcacattttctttatccactcattggttgataggcatttaggcttgttccatatttttgcaatggcaaactgtgctgctgtacaaatgcatgtgcaagttgtgcaactgcctccctccctccatctctctctctttcctttcttccttccttccttcttttcttctttccttgttttctccctccctccctccctccctctatctctccctccctccctccctctctctctctttctttctttcctttctttctttcttttctttctctctctctctttctttcctctttctctagccctgccacccaggctggagtgtggtgccatgatctcagctcactgcaacgtccaacctctgcctcccaggttcaagcaattctcctgtctcagcctctgggattacaggtgcccacaaccatgcctagctactttttctatctttagtagagatggggtttcatcatgttggcctggctggtctcaaactcctgacctccagtgatccacccacctcagtctcccaaagtgttgggattacaagcatgagtcaccatgccccgcacaagtgtctttttcatataatgacttcttttccttcgagtagatacccagtagtgggattgctgaatcgaatggtatttctacttttagttctttaaggaatctccctactgttttccatagcggctgtactagtttacattcccaccagtagcgtaaaagggttcccttttcactaccttcatgccaacatctattatttttttattttttaataatggccattcttgcaggtgtaaggtgatatcacattgtggttttaatttgcattttcctgataattagtgatgtcaagcatttttttccatgtttgttgggcattcgtatatcttcttttgagaattgtctattcatgtcctttgcccactttttgatgggattatttgtttttttcttgctaatttgtttgagttccttgtagattctggatatcttgccgattctggatattagtactttgtcagatgcatagtttgcgaagattttctcccaatcggtgggttatctgtttactattattattattattattattattattattattattattgctgtgcagaagctttttaattaattaggtccaatttgtttatttttatttttgttgcatttgctttggggtttttgctcatgagttctttgcctaagccaatgttgagaagagtttttttgatgttatcttctagaattttaatgatttcaggttctagatttacatctttggtccatcctgaattgatttttatataaggtgagggatgaggatccagtttcatccttctacatggggcttgccaattatcccagcaccatttgttgactagggtgtcctttccccacttcatgtttttgtttgctttgttgaagatcagttggctgtaagcatttgcctttatttctgggttctctattctgttccattggcctatgtgactatttttataccagtgccatgctgttttggtgaatatggccttatagtgtagtttgaaatcaggtagtgtgatgcctccagatttgttctttttgcttagtcttgttttggctatgtgggctcttttttggttccatataaattttatgatttttgttccagttctgtgaagaatgatgatggtattttgatgggaattgcattaaatttgtagattgcttttggcagtatgttcattttcacaatattgattctacccatccacaagtgtgggatgtgtttccatttgtttgtgtcatctattatttctttcagcaatattttgtagttttccttgtagagatctttcaactccttcgttaagtatattcctaagtattttatttttatttttgcagctgttgtaaaaggaattgagttcttgatttgactctcagcttggtcattgttggtgtatagcaatgctactgatttgtgtacattgatttttgatcctgaaactttactgaattcatttatcagatctaggagctttttggaggagtctttaggattttctaggtatacaatcatgtcattggtgaacagtgacagttggacttcctcttttctgatttggatgcctttatttctttctcttgtctaatcactctggctaggacttctagaactacgctgaatagaagtggtgacagtgggcatgcttgtcttgttccagttctcaggcagaatgctttcaacttttccctattcagtacaatgtgggtttctcctagatggtttttattactttgagttatgtcccttctatgccaattttgttgagggtttttatcataaaagtatgctggattttgtcaaatgctttttctgtgtctagtgagatgatcatatgatttttgtttttaattctgtttatgtggtgtatcacatttattgactcgggtatggtaaacctacatccctggtatgaaaccactatatccctagtatgaaacccgcttgatcatgatgtgttatcttttttgaaatgctgctggattcagttagctactactttgttgaggatttttgcatgtatgttcattagggatatttgtacttttagttttctgttatgtcctttccaagtttaggtattagggtgatactggcttcatagaatgatttcctctttttctatctttttgaatagtttcagtatccaattcttctttaaatgtcagatagaattcagctgtgaatccatcgctcttggactttttttgttggcacttgtttttttattactgtttcagtctcactacttgttattggtctgtccagagttcctgtttcttcctgatttaatgtaggagggttgtatatttgcaggaatttgtccatctcctctagattttctagtttgtgtgcatataggtgtttataatagccttgaatgatcttttgtatttctgtgatatcggttgcaatatctcgtttcatttcttattgagcgtattcggatcttctctcttcttggttaatttcactaatggtttttcaatcaattttatttatattttcaaagaaccagctttttgtttcacttgtcttttgcatttttgttgttgttgttgttgtttcagtttcatttagttcttctcttatttggttatatcttttcttctgctttgtttgggtttgtttttttcttgtttccctagttccttgaggtgtgaccttagattgtctatttgtgctctttcagactttttgatttaggcatttaaaactatgaaatttcctcttagcatcacttttgttgtatcccataggttttgataagttttgtcatcattatcattttgaaagaatttttaattttcatcttgatttcattgttgacccaaagatcattcaagagcagattatttaatgtccatgtatttctatagttttgaaggtttcttttggagttaattttcatttttattccgcagttgtctgagaggatacttaatatgattttgtttttcttaaatttattgagactcgtttagtggcctatcatatggtctgtcttggagaatgttccatgtgctgatgaaaagaatgtatattctacatttttaggtagactgttctgtaagtacctattaagtcaatttgttccagggcatagtttaagcccattgtttctttgttgactttctgtcttgatgacatgtctagtgttgtcaatggagtactgaaatcccacactattattatgttactgtctatcttgtttcttaggtctagcagtaattgttttattaatttgggagctccactgttagatgcatatatatttatgattgtgatattttcctgttggactaatccttttatcattatataatgtccctctttgtctttttttttttccactgttgttgctttaaagtctgttttgtctgatataagaatagctactcctagactggccgcagtggctcacacctgtaatcccagcactttgggaggccaagatgggcagatcacaaggtcaggagttctactaaaaatacaaagaaattagccaggtgtggtggtgtgcgcctgcagtcccagctactcaagaggctgtggcaggagagtcacttgaacccaggaggtggaggtcatagtgagccaagattgcaccactgactccagcttgggcaacagagcaagactctgtcaaaaaaaaaaaaaaaaacctactcctgctcacttttagtttccatttgtgtgaaatatctttttccacttctttaccttaagtttatgtgagtccttatgtgttacgtgggtctcttgacaacagcggatacttggttgtcggatttctctccattctgtcattctgtatcttttaagtggagcatttaggccatttgctttcaatgttagtattgacatataaggtactgttctattcattatgttagctgttgcctaatactttttaaaattatgttattgctttataggccctgtgagatttatgctttaagaaggttctgtttgggtgtatttcaaggttttgtttcaagatttagaacacccttaagcagttcttgtagtgctgatttggtagtggcaaattccctcaacatttgttagtctgaaaaagactatctctccttcatatctgaagcttagttttgctggatgcaaaatttttgactgacaattattttgtttaagggggctaaagataggaccctgctcccttctgattggcaaggtttctcttgagaagtctgctgttaatctgataggtttttctttataggttacctgatgcttttgtctcacagctcttgattttttcctttgtcttgactttagataaactgatgactgagtgtctaggtgattatctttgcaatgaattttccaggagttctttgagcttcctgtatttggatatctaggtctccagcaaggccagggaagttttccttaattattcccttaaataagtttttctaatttttagatttcacttcttcctcaggaacaccatttattcttaggtttgactgtttaatatagtcccaaatttcgtggaaactttgttcatttttaaaaattcttttttctttgtctgattgggttaattcaaaagtcttatctttgagctctgaagttctttcttcttcttgttctagtttgttgctgaaactttccactgaattttatatttccctaagtgtatctttcatttccagaagttgtggatgtttttctttatgatatctatttctctggagaaaatttcgttcatattttgtactagtttttaaatttatttaaattgttttttgcctttttctggtaactccttgagtagcttaataattgaccttctgaattctttgtctggaaattcagagatttcttcctggttcggatccattgttgtggaactacagtaatctttgggggttttatagaactctgttttgtgatattaccagaattacttttctggttccttctcatttgggtagactattacttaaaattgtttttgtggactgtgttttttttttaatttcttattttttctttcttaagaatcagactctaatgtttattttagcctaattggagtcttggtgcttgtaggggtgaagactctgtacgagatccttagttacagaatcttcctgcactggttttccccaatgctgattttagtagttacatacttggtgtgtgggtgaattctctgtctcctgtgaagctggaatggcagggatcccttgacgcttatgtcctcctctcatggtatacagtttatttactggtcttttatttactgagttgatgattcaggcttcaggacaattggggaggtatcccccggcaggcaccagttgtggctaaggcaagtgggtagatgtaatacccaatggcgagccgaggtcacagccttgatgagggtggctggaggagctctcaattaggtgtgctgaaattttatcaaggtgaaaagtgggagcttcctcagctcccctgccaagtcagaaagaaaactattcacctcacagcctcactcctgtcctagcatttcagctattcagatcagacaggcatctcttttcatctataggaatgttgttgttccaagtagggaggaactgtgactctgcctctcatgcaggcctgaatctggggtttgctcctcttgtgggcgatactcaccctggagtgttccagaaaggctgtctacaggtgtatccatgtgtgttcctgtgggggaagccccagctgtgtctgcagtggagtgccagggggaacaaggactccttttccaaggcccttcatggtcacagaggctgcttgcctattggggtataggtgcagactttccctactgcacctggcactgcaattgggtctctgctgtgagaaactacccactagcagaaagatctgaaactcctactattcagattattttgtctcacttagtgattccttgatgtggtgttctcctctttcccctagggatgggcttcctgagagccagattgcagtgactgttattgttcttctgggtctagccacccaatggagttaccaggctctgggctggtgctggcgaatgtctgcaaagagaccggtgatctgatcagtcttcaggtctcctagccatgtataccagcacctgctctggtggaggtgacaggatagggatgtagactctgtgagaatccctgattgtagataggtgtagtgtgctggctttctcaaatgctagttatgctagtattgaagttgccacgtggacagactaaggacctctggttagccaggatgttgcaggcagtgatattagctgttgttttctccttcctgggagcaatattattgtcatgagtatggcctgagttggttggcctccagccaggaggtggtgtcttttgtgttcggctgccaaggcagatagaaaaataccatcaagtgggggcaggattaggcgggtctgagctgagactcttcttgggctagtcttgccacagccactatgtaggatggggaggatggttttcaggctgatggggttatgttccagaggggattatggctgcctctgtggcacagaatagttcaccagggaagtggagaatagccagtagtgaaaggcttcacccagctcccacacagttggtgagcccaatctcactcttgcaatgctgtgttaacagcaccaagtttagatccacgcctcctgcttgtggaactcagtcttactccaggccatacacttccccactgagaaagcaagcaaggctttcaggccacacccctccctgtctgcccacaaggttcctgtgctcatatctgctgcagttcccattcacccaccagattctgttcacgcaggttcatgccccctcaaaattatcacaaaattcatttggaagcttctttcaccttgtgccccctccctaattctgctggctgccttccctgagggcccctgtgagatatagtcaggcatggcttccctgggtttgagctggagactgggagtgcctacaagactcttcctgctgctgcttctacttttgtgtttcacgtggctccctaaatctgttccagctctaggtaaggttaaatccttctctcatgatctggattttcagattccccagtgaggatatgtgtttggaggcaggttttcccccattcacactttgggaactcattgctttttgcctgtctcacagagtttgcagcagcctgtcacttctttcaaaggatctgtgaattctttccattttcctgatatgatcctgtggtggttcttggaaaaaaggttcacagtctgagtctccacacactgttctgtccatccaagcaggagatgtatgttagccctgcctgctatctgccatctttcttctgtccccaatccttctctttagatagctgagataccatcttttgtttcttctgacttggttctattcactgacattcctctctatcaagtagatttttgaactttcatggaaatttattcccaatttatatggaaataattcccaatttatatgaaaagcttataaagtgattcattaaccaagtatttactgaggtgctaaaagtatactctgaagcaggagtggcaagtcctttgccttcatggagattgcattctcttgtaaatcttacatgatggtcactagatttaggaataaaggactccagcataaaacactgacacttctgctggagaaatattttacaaactatatatattgaagcccaaactctggtttattggtaaaggagtagcactgatactagaattttgtgatcaacatgttggaataagaagtcagaagacttagatctgtgttctttttctcccgctggctataggttgctttaatctctgagctgcagtttcctcatctacagaataggttagaccagattagtggtcttcaactttggctgtatattagaattatcttactcttgaccaattaggttagaaatttcgggccacacacaatggcttacgcctgtaatcccagcattttgggaggcagatacgggcagatcacaaggtcaagagatggagaacatcctggccaagatggtgaaaccccatctctactaaaaatacaaaaattagctgggtgtggtggtacacacctgtagtcccagctactcaggaggctgaggcaggagaatcgcttgaacctgggaggcggaggtggcagtgagccgagatcgtgccactgcactgcagcctggtgacagagcgagactccgtctcaaaataaataaataaataaaaattaaaattagaaatttcctggtggagaggaaagcagaggtatttttaaagctctcaggtgatatatttctgttttaaggtaggactaaaaatcatgggactacgtcagaagttctaattataaatctataggttagttttctccaggcatgggtatagtgcttaaatgccttttaaatttgttaccaacatagaaaaaaaaaggtttccggcttctcttgaaaaatggaaatattaggcaacagttgggcttatgtttctgagtggtaaaaattaaacaaagtaaacgagtctccgtttcatttgttcctgttgccttcctggctcttgaaggcattgtcatttgtgaaaactaaactagatggtctttaaaatctccaattatttgaattgcttatttccacatccagaaaagagacggtaaacaaactatacctttatctgtaagctagttggtttgtgaaatcaaagggaacttaatctttgaatatggaaaaatcccagggtccaatggaagagaaactccatctcattaatagcaggactccacagactgctatggaaaagacacccacccggggctaagagggagggaggcggaagaggacttaattcattttctgggcatttttaatgaagctttcccctctttcattatttcttatttgggagctggatcattagttgggatgtgactggctttccctggggagcaaaaaggagattaacagaggttttgctcgcttcttcctgtgatttactgtgggaagtctcccaggttcttcccttcgcttctctgtggccttcatcttcatggtttcttgctgtgtctctctgagagcaagtacctgggtgaaaaaggctgagtgtgtggttttttggcaactgcctggcattggatttaagtgggtatatttgaattactagaattttacattttataggttcaaaatatgcacttgaattctgtaggacctcttacccaaattgaataatcctttgtgccttgttaaattttaaaaagtcacactatcaacattatgacatatggcatatatgatggcaataataaaaataacacacttattgtccactttaatgtgccagcagtgttccaagtgatttgcgtaaatatcaaatttgttccacacaattatcctatgaactaaatgttattatttcctggtttataggtgaggaacacagaggctcaaagcagctatttgatttctcttatttcaaaattaggggaagtgagatacattaacctgtataaccagaccttgttaactgtttttggtaaattccaatgtgtattgattttcacaaagacaaatcacaccattgttatattaaatattaattttttcatagtccctcaaggtgcttactggctatattgttactgtcttttgatgttgtttatacatggtggattacagaattccatgaacataaaaaatcttgactttatcctagcctatttcctattcttaccccctgcaaagtaaaaagttcaaaatagcgttagtaagccaagcaaactacttactagccacatgaacctactagcctctctgcctcagtttctttgttgggaaaatggacaatacctaactcaactcataaggatatttctagaatcaggtgtaatatcaaataaaaatatatttcctttttcctagaagatacccatgtatatcttaggtactgatgtattcatagtgatgcagaacataaaatgtttattcttttgcttagcaacaactatccatagagatttttccactttagagatttaatcccattaaaggtttttagattgattggacaatgagaatgtttttgtctctctgaaactgaggctgaaagttgatttcattctctcacttcaaatcatactacaaggctacagtaaccaaaacagcatgtcactggcacaaaaacagacacatagacaaatggaacagattagagagcccagaaataatgccacacacctacaacaatctgatctttgataaagttgacaaaaacaagaaatggggaaaggactctctattcaataaatggggctgggaagctagctagccatatgcagaagattgaagctggacccctccttacaccatataaaaaaatcaacttgagatagattaaaaacttaaatgtaaaacctaaaactataaaaaaccctggaagataacctaggaaatggcattctcgacataggacctggcaaagattccatgacaaagatgtcatgacaaagatgtcaaaagcaattgcaacaaaagcaaaaattgagaaatggaaacagattaaactaaagagcttctgcacagcaaaagaactatcaacagagtaaacagcctacaggatgggagaaaatatttgcaaactatacatccgacaaaagtctggtattcagaatctataacaaacttgaacaaatcaacaagcaaaaaacaacccaattaaaaagtgagcaaaggacattaacagacatttttcaaaggaagacatacatgtggccaacaagcatatgaaaaaatgctcaatatcactaatcattatggaaatgcaaatcaaaaccacaatgagataccatctcacaagtcagaatggctattaccaaaaagtaaaagaaaaacagatgcctgtgaggttgtagagaaaagggaatgcttatacactgaaaagggaatgcttatacactgctggtgggaatgtaaattagttcagcaattgtggtaagcagtttggtaatttctcaaagaactcaaagtagaattaccattagacccaataatcccattattggatataaacccaaaggaatataaatcgttttaccataaagacacatgcatatgtattttcactgtggcactataacagagacacaataacaaagacatggaaccaaactaaatgtccttcaatagtagactggataaagaaaatgtgatacatatataccatggaataccatgcagccataaaaagaaatgagatcatgtcctttgcagcaacatggatgaagctggaggccattatcctaagtggactaacacaggaacagaaaaccaaataccacatgttctcatttataagtggaagctaaacattgggtacatatgaacacaaagaagagagcaacagacagtggggcctacttgtgggtagagggagggaagaggatgaggattaacaaactacctatcagatactatgcttattacctgagtggcaaaataatctgtacaccaaacccctctgacatgccatttacctatgtaacaaacctgcatagtacccccgaacttaaaagttaaaagaaaaaaaaatgattaatgagcgtgataccagaacaatattatgatgcagggctattttttgtgtgtttgctagctgggcttgagatttgataaataagtcccattgtcctaatccgctagtgatgatgttctagcctttgaaattcaaactactactactccactttgagagagactgcatgagaattggacccagcctggggctttagacaccatggttcaaatcttggctcttatcattttttagccacgtgtcatggactcaatgtttttgtctcccagctccccagattcacaggttgaagccctaacctccaatgtggctgaatttgagattagggcctgtgaggagctggtaaaagttaaatgaattcttaaggataggtctccaatcctatagagttggtgctcttacaagaagaggaacagacacccgagttctctctctttgctatatgaggacatggtgaggagtggccatctgcaagctcagaagagagccctcaccaggaacttaagtgtctggcaccttgatcgtggacttcccgacctccagaactgtgagaaataattttttgttgtttaaatcacccaaactgtagtattttgttgtggcagcccaagccaattattataccatgtaagcaggttacttaaatttactaaatatgtaagttacttaaaatttcaaatcctggttctaactttactagctatcacttttactagctaacacattacattttcttcaacttgccgcatgcttttgctgtgagttttaaatgaaattgcttaagtactttgcttatcatactgctgatccatagtaagcacttaaagttagtttccaggaagtttggaatggatctcacttatgcaaatggttgactttgacggtgcttgttcctctctggaaagggttcacctcccattagaatagtcctgtgactgcagtaattttgtatgttaaacttacatgtatatctgcagaatgttaaatctgcaaacaccatccatcaacccaaaagcaaaaaaagagtgtttcctaatagttaatagttggtagcttaataggaaatctagaaaaaaaatgtttaataatgaaggctatattaataccaagtctcatttgagttcctgtcagtaaggaaatagttatctttcgttgttaatcaatgaagaccagttgccataattagggctctggtgtgttttcttcacatggtcttctaggacctaatgtaatatcatttgagaggctcaaagaggatcccatattcccaaaggtatcttagagtccttagctgcccaacatcccaccattaatcatgctttgcagatgaaaaattgaagactccttgtctctgaatatctgggatatgctttcattcctaggatggacatttttcttcttccccaataaggaagaaaaagggacagaggtgatttataagagcagttctactgagtgaaatgtgggtcctagcaaaggaggacacagctgccccttgtaatagtggagggaaggaaggaggcaggctggctgtactttgccctcctcaaccctaaaccctatctgtttaccacagtggaccttttttctgaactctaacctcattatttcattcattatccacgtaatattcattaatgttctccaaggctcttagaataaatctttaacatttccccaaaaagtcacaaggtctgacacctgccttcctttttccagcttcctatcataatcctcctttttggcagtggccacactgatcttctttcaggttcccaagctcagcatttgcttttcattgggagccccttacatcatgactgtcagcctgattgtcatttctttggggaggccttccctgaaccctggaactggatcatatacccctatcatgtgctttcatagcaccatgaatgtctccttggtggcagtccccagtaggagaattctgtgtttatctgtatggctgtttcataaatgtttatcttcctcccaatagtctgtcagcactttggcagccagttgtgttttgctgttgattctacctccagcacagaatgtctcttagtatttatggaaggggacatgaaaaaagaaaaagtccactgcatgaagatttaatccagcgacactgaggcctgaacatctagctttagggaagccagcttctagcaggacagactggtagggactaggtaaggagaatggaaaaacacagggaatgagcatcactttctttaagactttgcctctggcagacccctccaagtaacagattccaaagagattgtgaatgttctccctctggtatgcagtctcctgtcctgtcagaaacatggtacccagaggccaaagctgctgcataagcaagttatcatgaaactattccaggacaggtttcagaagcagggtcttaaaaatgagtattaaatctaatgttcacccagatacatttccaacccacatatagacaccgaatttaacgatgaaagtggaagttactctgttgaggatttatttgaaatgttggttttctcttgtccatctgatacaggtcatagctctgtttctgtcattagattgattttcatgtttctcagcacagactctctgtgagtcagagataagtttaatttttcagcatggccataggaatgatgaagtcattcctcattaaaatgaagctaagcaaaatttaatagtacttgtttaagattccttatttacttttctacacaaaaagagttgcaaggggaaaacaaaaactttagctttgagtaatttccttaattcaaatatagatttaaaccactttgtcataatatgtaaatgaactattgcttttttcaccacaggtctgttttcaaatagataatgagattatataaataattaccttatataaacataaggttactcattattgaaagcaattttctttttttgtttctggtttattatggttaagagtgagcctttgttttagatatttgaaaacaaaatgtgtgtgtgcgtgtgcttttgtgtgtgtgtgtggatatgtgtatctagggaggtcctcaaattcaaaaattataatacaaggttgtaatgtcagcacttcctattgcatagttttataatggggatatatagctatgcattaaaatgcattattgaaatggaaaatcaggatgtgttaaaaatgaattagtaattatattaagatctgaatgggaactagcatacaatgtaacttaagcttttgaaaaataaaaaaaaacagaaaataattaatgataagttagtttcagtattacattgataaatatttccagaataagctataaaaaataaggaggtagatttattattttaaggttcatactaaaagattgtaatatttacttaacctttctttatttaatttagaataagattactgtcatctctctaagcatctatgtaatagtgttttatttacttttccattaaatattactgagataaataaggagtcctggtgaatgaaatataatttaataagcagagttttcttaggtgaaaactaatcatgtcctgctataaatgtatattgagagagaagctgaatagacaagctccatgatttagtcaatgatacgacttcagggaaaatgtttttatgccttgttggccatatcttttaatacttgcattgaaaataaaattacatcccaagattatgagggttgtgaaattttataattagatatttaagtcctgaattgattagcagcagtataaacatagacatggattttgggttaaatctgagaactatttttttgtactaaaatttgcgtgcagatgacaatgggaaaatcaaatgttttcctggaaaattttcaaatgggacaaatagtcatctttctggaaatatgaaataaagggagtggtagtggttggactataaacctctttgaaggccttttaatctttagctgtaattcatgttttatcaccattggattttcaaaacggaaaataccttagaaataatttagtgggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgtgaacccgagaggcggagcttgcagtgagccgagatcccgccactgcactccagcctgggcgacagagcgagactccgtctcaaaaaaaaaaaaaaaaaaaaaaaagaaaaagaaataatttagtgttaccttgttgatattaccaaaaaaaaaaaaaaagtgctcagagtcacataacttgattcagtcagagctggtactagatgctcagtcttctgacttctaatttagtttgctttcattatctacttactacctgctgctgactcagagctcctcagctatctgcaagtggatgtgtttattgaacatttacgatgtacatgaactgctctcaatgcgaagctcccatggtgaatgggagcttactttctgactcaaaaattagttttctctctttgtgttctaaatgaaagtgtccttttgctttatctgaagcagaaagttgtaagtttgtttattttacttttgaaattttggagaattggcagtggggtcatgccatcagaaacacatacatgcaatgcatggatgcacggtgtgaatgagctctctggaagatggtagattatgggaaagaaggaagctcagaaagagagtggaccaagtcaagaggaaagagagaagaaacaggcaagtgtggagcagaggaaaagtaggagggtcatgaatccattctgcaggtgtgtgctgagtgactggaagaaggaaaagaaccaaggaagtctctgccatgttatcttagttttgttaagggtataaagagattgaagagagtttaactaggccatctttaaccctaggacatccctagagtccctggcagaactaataatctaaattatgaatggctgtgtgtgcacacacacaggatgcacttactaatgtctatcattatgagtatcttctgacttctccactacaaagaaaggaagggaatgtgaccctctttccaggttagaagtaactagggcatagtaacacaaatggatgaattaaactgtttaaatggtgcactggaatatatttattttggggcaaatcatgaagaaataaaaaaggaagagattctcttttgagaaaaagtttgtttcctattgtcaattgagcaactctgtgaacatcttaaagataaagaatgattattctgtaaagtgctgggatttctggtgctgtgtgacaaagtccggttccttttgtctaagttagttataataatctttaatgaaaagcagaggggtcccatggtttggaacaagtatctgagtcaagagttgacaagtagaatagctgggcgcagaggctgctgtcaagttgacaaagccagaacagtacatttggacagaaagaatttgattttcttatactgaatgtgatgatcttgaagaacagattttttttttgcatgaaaataaatctttattttcagttattacccaccagtaagagaaagttaggttaagggtataaagggattgaagaggtttctacttttgcccagtccttattttgaatagccttccactcatccaaagtcatctcttttggaccctcctcttttacctcttcaacttcattctccttattttcagtgtctgccactggatgatgttcttcaccttcaggtgtttcctcagtcacatttgattgatccaagtcactgcaattataagatatttgtttctgaatgtatttgggggactctgttaattcatctttgacaattccccagttgtgagatctgctacctccacgttacaggtcctcgtgcttcaggccactgtaatgtgaaaaaaaagatctatcacttccactatacctatcaaattcacgtttgccacgagaatcaaatccatctccttggcccatttcacgtccactgccctctcgacctcttccaagaccaccatgaccttgaataggtcggtcaataatcagtctatcaactgaaaattcgcctccttcacccctttcatcaagtggcttttcaagtcttcgttcacaaggtggtctcctttctggtcttctatcagttattttcccttcaccgtgaagttgttgagcaggtcttcttccaacttgtcttattccttcttctttttgtgttttttatttttcctctaggcaagctttattctttgattcctctatccaggaagggggctgttggttgcatcttacccaaatggaatgcaatgggaattgggagcttgagttgtgtggaggaggagttgtcaatcttaacaaatgactatagctggcgtgtggtgtccatcaatccttgagggcttggccatgcacactagggaatggtcagaacagactcaacagaggtctccagagctttacaatatctacaatatcaaggttcagggggtatagacagtaaggaaaaaggccatttcctgtttctgtccatttttggtacagtagacagttaaggttttttcttttgactagcttttaaaaaattacttagaaaatggaaagcttataaacattcataagtgaattgttgaattgctaccccaagtggtttccttacctagtcaccacttaaccagaaatactagaatacacggttcaaccagaattcaaccaggcagataacctgcctattgctcaagcaatcatcagagtttttaaaaacaaaattaagcaaaaaagacctttccccaaatacaatcattactttgtatgacccattcctaagaaagctacattccatttcagaaaacatgaccacttaaggtacagttaaaacaaagtcgttgccttcaggtgcttactttctgttttctttaaattaactgctgaaatgtttatcttgtgttttgtgctgcattcctgaaaactgtaacttttaaggacataggcctcatctttataaaggaagaagaaaacagcaaagaggtgtctcatttgggaggcagaaggttatgaccaatgctggaagtcttcctcttccttacttgttgttcaacaagatgggttctgtggtgtcgcatgaggtgtgagttggaaatgaaagctgcaccacacttcttatattcatagggcttctccccagtgtgggttctctggtgcaccgtgaggctcaacctctgtctgaaggccttcccacactcattacacatgtaaggtttttctccattatggattctctgatgaataagtaggtatgagctacatgtgaaggccttcccacattcattacacacaaaaggaagatctccactgtgaattctctggtggacaaaaaggcaagagagctgactgaaggcttgcccacattcactgcagtcataaggtttctctgcagtgtgaattatctggtacataataaggtgtgaaaaacaactaaaggttttcccaaactcacactcatatggcttctcaccagtatggcttcgctgatgtacaataagatttgcaatctgcgtaaaggctttgccagaatcgttacaggcagagggcttctccccagtgtggatcctctggtggacaatatggtttgagctcccagtaaatgttttccgacactcattacatttacagcatttttctgtaatgtggagtttctggtgccgagcaagttgtgagctataactaaaggctttctcacatttactacgcctaaaggttttttctaaggagaggtttttttgatatacagtcagatttgaactctgattgaaggctttcccacattttgagcaaacataaggtttctgtccagtgtggattctctgatgcacatcgagctttgcactctgaatgaaggccttcccacactcatgacattcaaaaggtttctccccggtgtggattctctgatgcacaacgaggtttgcactctgactaaatcctttcccacacatgctacaatgtaaaagactttcgcccaagctgggttttcggattgttaacagtgtcagaattaaggctgtattttcccacagatttcttacatttctggtcttcctcttctttgaagctttcaggtaagtgacagtcattcactatgacttatctgaaatctttcctttccctccttattctctgcctctttaacatgttttctttttcacaagcctctcttaactcaggtccttaaggatcagctttctggattcttcctaatatgatgcgggggttttcagcttcctcacgtatctcagtttttggaaccagtaactgaaggttcttggtttcagcaccttttcttcctcttctgatccatcaaggcctgtctgacgaaactcccctggggcccagactttgatgttctcagagtgcacttgttggctggatgcctgatctgggaagttttcttcttcctcctcctcctttttcaccttcactgggcggcatgggcctagggccatggcttctctcaattctgcagtcatcttctctgctcagcaggggaacgcctatagctgggagctgcccagcacaggtcaaaccccatctaagctttatgtttcaaaagcttcttcttgagtttcctcccagggccaagatgagtattgcctacgtgcgcagctgagaggcccgaccagagttcactggctctgcagcaggaggctgggggaccaggacctcagctcctactggcacgagaacaatgacccttattccttctttcttaagcaccatggacggctgcgtctcctctttcctgtcaaccacgccaacgctggagggcagcgggttcttgctgtctttctgggactccttgcgcagctagctatttgcctgccgccttggagttggtctgggtcgcagcctgagctgccgctcttggccccagagacgccgcccccgccagcttcttttttcttgttctctcctgccttcagcacctcgaaggggtccgattagttgtcaaataactggtcgaatcggttggtgaccaggcagctgaagccttcctgtaactgcccaggcatgatggttgctcggcggcacattcctccacggattgcagcgggctgcgccgagccaagagcgcgtgcttcagctcttcccagaagatcgaagaacaatttttttgaaatccgcctgtaaatgtcaggcaaggtaaatttcaaaatgaatttttaaagtctctaaaatggagttatgtttaattatgactttatgacaaattaaaagatagttctagataatactattgtagaaagaagcttctcttgttctgggaaagagagacagtttggaaacttgagacaagacccttattgtctgttttattatttactgctaacaaactgcattctctcactgttcactggaataggtgggtccagggaacttaggaaagcctaatgggaagtgagaaaagtaaattatttcttatatttttatgtatacaaatagttgataaaggaggaagtgtagtggtggggtggatcatgcagattgggatacaagagacagtataattattcacaattatagataaggagatctaggcttcacattttcacttctggaatattccactttgacagaacagtctactgtctgcctcagcctatcctggagatgtccttgtggtgggagaggacctgctttctccttgctgtgctcctacagtttgtctctgccagtcatgtccaagccccttgtcttagtgcctcacaagacctcttcctctgaccaggattcaggcaccttctcagaaccttcattcccctgacagcaggaccagccagtctcccagacccggggtagtgcgaagaggagagcagactccttagacccagagtcccaggacacttggcctcaattcccgtgacacctatatcacccagacaactgggaaatggaggtgctggtgccagaacaaaagcataagctgtgtttctcaagtttggactttacctgggctgttgctttattttctagctgtttactgatttttagaagcataaaggtttctttctgtgaagttcctagggacacttaacggagtggggacaggtattccttttgtctttcagaaaggcatgttaagagttagtctcacagtaatttaagtctcacctcctaaatggggtaagagtggggagaaatatatgtgtgtatatttgtgtgtgtatataaataatatatatatactactaatataattaataatgtgtgtataaataatatgtaaataacatattatattatatgtcaataataaaatattatattaatatatgttattacattaatatactatatattataatatataagatataattatatattatatactattatattatatctataacataatatattatatatttatatatcattatataatgtattacatgtattaatatatattatctatatagtaaatatatggggtgtgtatttgtgtatacacacacacacgcacatatatatcctgcattgtttgcttagaatcatgctttgcaattattaactgctttttcttccttcccttcatctaatacacctgaagaatatttcagttagccaaaggtgagaatccgaattcatatttgtattcccaatagatttcccgcagaatcttgggttatcatttcatcaataacagttatgcagatgttctattgctgtgtccaatgcttgcttcgttcatatgaaatttgacttttggccattcaaaaagcaatcagtgccttcttgttgattagcactaatcaccacaagatccttccaatagtaaattttccagagcaaaattctaaacttacagattagtttgccgcagcccctagccctacactgtaaggatcttgctttccatgaggtccattgttaaatggaaatgttcccctggctctatgcagtgctcaggtgtttcttactcagctgaaggactaatgaatttagtttgaatctaaatttggagtaaaaaatgccactcaggagagctgcttctgtgactgcattgccttccaacctgcttttccatttttccttattactccatgtccttgaggagtttattcctttatagcttttgtgatctggctgtaattattttgaaaaaaattttcattatactggacattttggattaagtcctccaaattttcttatttgtgagagtacaagtcactatttacactatggtaaactgcatgcaaacatctgagtacctttctgttcctgtcttcagctgggccagcactaagctggaatagcctatactttgatgtttttctgaggaagtacattttccttttccctcagattcctggtgcctggtatagcacttttttgatttgctcttgttctggcaataggtcaactggctttcatggtccttaacgtttcaggtaaataattccaacagttgtgactggaaggaattcaaatcaactcaaggcatccactctatgttcaaaatgccatgttttgagtgatttgtcctttggttagtaactttaaaaaatatgaggactggaaggagaagctactatttgaggaactaatggaaaatcaagcagtttttgatgtactaacatatacacttatgatgcaaggagtgtgatcgttgaccttcctacttatctaaacattatgctctcagagcatgtggataggtagcatagcctagtggttaacacacatagaaaagtcagactgcctagttcgaatcccagcttcatcacttgctagctatataatctttattaaattagttaactttcctgtgcctcagtctggttttcctgaggattaaatgattttatatttgttaagtgcctagaactgtagctggtctgcaacaagtactatacgtctttgtttaaataataaataaaatgacagtattgttcatatggagaaacaggggtcttaggcagcttaggagtttttctaaagtaacagaatcatttaatggcaggaacaacaatattatcactgcccagaaccctaatggagaactatagctcttaagggtgatgtggggagaaatacactgatgaaaaacaatcaacattattaaagacaggatgggagagagtgggaactcgtcattcatttatctaatggcttagtcagcaagtaactaatgcctactttgggccttgacactataccaacattgtgcagaaagtgattaaaatgcaaaagaacattcacttaggctgggataaacaagaggtcttttgcaaaatctgatgatgagcttgttgatgttgagttgacaaactatgcagcaggtcagtgggggggtgattatcataaaattccatcccttaaacatctacaggaagatgattattttaagatgctttacttctggagatgtatgctttacttctacttagagaatctggcttatgttctcatgttctggttttatatgtaattggtcatgagcttaatttgagccaagcatttgacacagttgcccccagaagttaactcatttgtggattgtataaatgctattgcacaaaaaagaagtatatatatacaaatagtcatagtagaccacatctcagttaatggcttcaagtctagatgaaatgttttaagagggatattgacaaattagagaacattagaagcatttgccagaatactggcagggcaagaaattatgccaaatagtagaaagagaattagatgcctaagtggaacatggtgtatagcccataagaatttgaaggattgtcactggtagaataagatgttattcttggctgcttccagctgaggagtggtggatgggtgactaaggcctataagagagcaaatataaggaagagtttctagatattaaaatcaatttccaaagaaacagcctggcctctaagggaaagagcttcttgtgagtagatgtgtttaggtggggccagatgaacaagctcctgagctctagggattagactccttctgctggataggaggtacaaccaggtcatcccagaggttccttgtgttccaagattctgttactctatgatttcatgacttggatgtcacctcccttaggttggttactctaaataatgttaaaagtcagtgtatgccttaagattgggtgaattgctatgacagaatgagatttaccagagaagcagttaagtctaagaatgaaactactgtttctaagtgaaagaggtatgaataacctaaagataatatttttctctgtagatagaaagaatttgtattataagtctgtgttgggtgtatagtagggcatcaccagaattcaccctaactgggtgaattcatggcagtgatcagtagaatatgtagtttaacaatgaggccttatcatttctaagtagtttctttttgagacggagtctcaccctgtcaaccagagctttgccctggaactcttggagtgcaacggcgcgatctcgggtccctgcaacctccgcctcccaggttcaaacaattctcttgactcagcctcccgatttctaagtggagagttatgaatggcccaaagataatatttttctctatagatagaaataatttgtatgctaggtatgtgttggatatatagcaggacattaccagaattcagcctaactcggtgaattcatggcagtgaacactgcaatatgtggtttaataatgaggccttattcttaaggcaaagctcagaaaagctgataagcaaattagaaaggtctattgaaaagtgtctgttggccgggcgcagtggatcacgcctgtaatcccagcactttgggaggctgaggcgggtggatcatgaggtcaagagattgagaccatcctggccaacatggtgaaaccccgtctctactacaaatacaaaaattagctgggcatggtggcatgcgcctgtagtcccagctactcgggaggctgaggcaggagaatcgcttgaaccatggatgcagaggttgcaatgagctgagattgtgccactgcactccagcctggtgacagcaagactttgtctcaaaaaaaaaaaaaaaaagaaaagtgtctgtctagccaggcgtggtggttcatgcctgtaatcctagcactttgggaggccaaggtgagtggatcacttgaggtcaggagttcaaaaccagcttggccaacatggcgaaaccttatctctactaaaaacacaaaaaattaacaggatgtggtggtgcacacctataatcccagctacttgggaggctgaggtagaagaatcgcttgaaccgaggaggcagaggtagtagtgagccaagattgtgccacagcactccaacctgagcaacagaacaagactcagtctctgaaagagagagagagatgaaagagagagagagagaaagaaaaagaaagaaagagagagaaagacagacagaaagaaagaaagaaagaaagaaagaaaaagagaaagagaaagaaagaaagaaagaaagaaagaaagaaagaaagaaagaaaagaaataaagaaagaaagcaaagtgtctgtctgccaacctgcttccacaaaggcccctcttctgattgtagaagtgcctggtttaggatggcagtgtgctctacctgctgtctggtgagtagtcaggattggacttctataagacaccctctgagaggcttgcaaataccttcagaatcaggcagaggtctttggccagttatttctgaataaagcatatctgcgtgtctgtctgacctaagcctgggaaccacgatggaagatactgtttgaacaacaacaacaacaaaaaaaggcagggaacttaagagagaaatggattttagtcactaagaacacgaagaggaacattttgataatatgtactctatacaaacagaatgcttatacaagacaatcaaagaggaatgggtagttttctaaagagtaaaacctgtatttttaggaacatatatttgtttacaatatattttttcttttttcacccttgatttttaactatttaataattttctacaacatttttttctttttttttttttgcccttttttttttttttttaaacagagtctcgctctgttgcccaggctggagtgcaatggtgctatcttggctcattgcaacttccgcctcctgggtttaagtgattctcctgcctcagcctcccgagtagcttggattataggcacctgccaccacacctggctaatttttgtatttgtagtagtgacggggtttcaccacgttggccaggcttgtctggaactcctgacctcaaggcccaccttagcctcccaaagtgctgggattacaggtgtgagccaccgcgcccagcctgcccttgatttttaactatccctcctgtgaaaatttaagtctttctgtgggttaaagggaactggtaaagagcactggatttatgcttgggctggaatttccctctaggtttggatgtaatgaaggcagtagagatttgggtttataacagaggcagatttgtgaaactataggagttgaagcctgagggtccctcacttgcagagaccccttccagggtcctggaaggaaccctgctaatgtgttattatggtcattttttttataaaaattgcaaaacataatgtgtttcagccatgactggttaagatcattgtcttcttccaattcaactttccctcctttctccttccctttctagttgggtggcattaaagtggtcatgcgcattttgtatttgtaattatgtattttttttttttcttaaaaaggacccccccaccaaattgtataagtttcaggccctaaaaacatggatcttccactgggtgtaggaatggaatgagtaacaatttggaaattgcctgtgtagcagaatcagcgaaaagtcagagtcagcagtcaaaatgtgatggggagagtgagagtaaattggaatccataatcccaacagcatttgacagtgggaaaatggagctttttcccccctctttagggttcattttaaagaattccatgcaaaggatatcatgaattgagaaatatacatcagattcatcagattaaaaattttttttttttttttgagacggagtctcgctctgtcaccaggctggagtgcagtggcgggatctcggctcactgcaagctccgcctcccaggctcacgccattctcctgcctcagcctcccgagtagctggaactacaggcgccaaccaccatgcccggctaattttttgtatttttaatagagacgcggtttcaccgtgttagccaggatggtctgatctcctgacctcgtgatttgcccgcctcagcctcccaaagtgctgggattacaggcgtgagccaccgcgcccggctttttgttgtgttttttgtttttgtttttgtttttttgagatggagccctgctctgtcgcccaggctggagtgcagtggcacaatctcggctcactgcaacctccgctcccaggttcaagtgattcccctgcctcagcctcccgagtagctgggattacaggcacgcgccaccatgcccggctaaattttttgttttttagtagagacagggtttcaccattttggccaggatgatctccatctcctgacctcgtgatgtgcctgccttggccttccaaagtgctgggattacaggcgtgagccactgcacctggcctaaattctttttaaaaatagcaaattcttaaaaataatgcaaattgatgatgaattatgaaaatcatgatgagaaactcctgactgaagagagaaattgttggaaaatgattctccttttcctctactactttatgtaattataaagcctttttctaaagttcctttctgacacagaaatactggccaacagaaattcaaaggaaagttgagacttttgaagttcaggcaatttatatggtgtttcaggtgttactacctctaatagtctatcagtaaaaccctgataggggatggtctctcctttttgccttctactccatctcttctcacacacacttgtgattctttttctttttttaaaaaattttattattataatactttaagttttagtgtacatgtgcacaacgtgcaggtttgttacatatgtatacatgtgccatgttggtgtgctgcacccattaactcgtcatttagcgttaggtgtatctcctaatgctatccctcccccctccccccaccccacaacagtccccagtgtgtgatgttccccttcctgtgtccatgtgttctcattgttcaattcccacctatgagtgagaacatgcggtgtttggttttttttccttgcgatactttgctgagaatgatggtttccagtttcatccatgtccctacaaaggacatgaactcatcatttttatggctgcatagtattccatggtgtatatgtgccacatttgcttaatccagtctatcattgttggacatttgggttggttccaagtctttgctattgcgaatagtgccacaataaacatacgtgtgcatgtgtctttatagcagcatgatttataatcctttgggtatataccccagtaatgggatggcaggttcaaatggtatttttagttctagatccctgaggaatcgccacactgacttccacagtggttgaactagtttacagtcccaccaacagtgtaaaagtgttcctatttctccacatcctctccagcacctgttgtttcctgactttttaatgatcgccattccaactggtgtgagatggtatctcatagtggttttgatttgcatttctctgatggccagtgatgatgagcattttttcatgtgttttttggctgcataaatgtcttcttttgagaagtgtctgttcatatccctcacccactttttgatggggttgtttgtttttttcttgtaaatttgtttgagttcattgtagattctgcatattagccctttgtcagatgagtacattgcaaaaattttctcccattctgtaggttgcctgttcactctgatggtagtttcttttgctgtgcagaagctcttgagtttaattagatcccatttgtcaatttttgcttttgttgccattgcttttggtgttttagacatgaagtccttgcccatgcctatgtcctgaatggtattgcctcggttttcttctagggttttcatggttttaggtctaacatgtaagtctttaatccatcttgaattaatttttgtataaggtgtaaggaagggatccagtttcagctttccacatatggctagccagtattcccagcaccatttattaaatagggaatcctttccccatttcttgtttttgtcaggtttgtcaaagatcagatagttgtagatatgcggcattatttctgagggctccgttcggttccattggtctatatatctgttttggtaccagtaccatgctgttttggttactgtagcctagtagtatagtttgaagtcaggtagcatgatgcctccagctttgttcttttggcttaggattgacttagcgatgcaggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttccttgagcagtggtttgtagttctccttgaagatgtccttcacatcccttgtaagttggatttctaggtattttattctctttgaagcaattgtgaatgggagttcactcatgatttggctctctgtttgtctgttgttggtgtataagaatgcttgtgatttttgcatattgattttgtatcctgagactttgctgaagttgcttatcagcttgaggagattttgggctgagatgatggggttttctagatatataatcatgtcctctgcaaacagggacagtttgacttcctcttttcctaattgaataccctttatttccttctcctgcctcattgccctggccagaacttccaacactatgttgaataggagtggtgagaaagggcatccctgttttgtgcccgttttcaaagggaatgtttccagtttttgcccattcagtatgatattggctgtgagtttgtcatagatagctcttattattttgagatatgtcccatcattacctaatttactgagagtttttagcatgaagcattgttgaatttttacaaaggccttttctgcgtctattgagataatcatgtggtttttgtctttggttctgtttatatgctggattacatttattgatttgcatatgttgaaccagccttgcatcccagggatgaagccagcttgatcatggtggataagctttttgatgtgctgctggattcggtttgccagtattttattgagaatttttgcatcaatgttcatcaaggatattggtctaaaattctcttttttggttgtgtctctgccaggctttggtatcaggatgatgctagcctcataaaatgagttagggaggattccctctttttctattgattggaatagtttcagaaggaatggtaccagcttctccttgtacctctggtagaattcggctgtgaatccatctggtcctggactttttttggttcgtaagctattcattattgcctcaatttcagagcctgttattggtctattcagagattcaacttcttcctggtttagtcttgggaggatgtatgtgtcgaggaatttatccatttcttctagattttctagtttatttgcgtaaaggtgtttatagtattctctgatggtagtttgtatttctgtgggattggtggtgatatcccctttatcattttttattgcgtctatttgattattctctcttttcttctttattagtcttgctagcattctatcaattttgttgatcttttcaaaaaaccagctcctggattcattaatttttttgaatggttttttgtgtctctatttccttcagttctgctttgatcttagttatttcttgccttctgctagcttttgaatatgtttgctcttgcttttctagttcttttaattgtgatgttagggtgtcaattttggatctttcctgctttctctggtgggcatttagtgctataaatttccctctgcacactgctttgaatgtgtcccagagattctggtatgttgtgtctttgttcttgttgctttcaaagaacatctttatttctgccttcattttgttatgtacccagtagtcattcaggagcaggttgttcagtttccatgtagtagagcggttttgagtgagtttcttaatcctgagttctactttgattgcactgtggtctgagagacagtttgttataatttctgttctcttacatttgctgaggagtgctttacttccaagtatgtggtcaattttggaataggtgtggtatggtgctgaaaagaatgtatattctgttgatttggggtggagagttctgtagatgtctattaggtccacttggtgtagaactgagttcaattcctgggtatccttgttaactttctgtctcgttgatctgtctaatgttgacattggggtgttaaagtctcccattattattgtgtgggagtctaagtctcttagtacgtcactaaggacttgctttatgaatctgggtgctcctgtattaggtgcatatatatttaggatagttagctcttcttgttgaattgatccctttaccattatgtaatggcattctttgtctcatttgatctttgttggtttaaagtctgttttatcagagactaggattgcaacccctgcctttttctgttttccatttgcttggtagatcttcatgcgtccctttattttgagcctatgtgtgtctctgcatgtgagatgggtttccttaatacagcacgctgatgggtcttgactctttatccaatttgccagcctgtgtcttttaattggagcatttagcccatttacattcaaagttaatatcattatgtgtgaatttgatcctgtcattatgatgtcagctggttattttgctcattagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagattagcttttagtctgatgggcttccctttctgggtaacctgacctttctctctggctgccctgaacattttttcctgcatttcaactttggtgaatctgccaattatgtgtcttggagttgctcttctcgaggagtatctttatggcgttttctgtatttcctgaatttgaatgttggcctgccttgctagattggggaagttcacctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttctcgcttcatttcattcatcttccatcactgataccctttcttccagttgatctcatcggctactgaggcttctgcatttgtcacgtaattctcgtgccttggttttcagctccatcaggtcctttaaggacttctctgcattggttattctagttatacattcatctaattttttttcaaagtttttaacttctttgccattggctcaaacttcctcctgtagctcggattagtttgatcgtctgaagccttcttctctcaagtcatcaaagtcattctccatccatctttgttccattgctggtgaggagctgctttcctttggaggaggagaggcactctgatttttagagtttccagtttttctgctgttttttccccatcttggtggttttatctacctttggtctttgatgatggtgacgtacagatgggtttttggtgtggatgtccttcctgttcattagttttccttctaacagacaggaccctcagctgcaggtccattggagtttgctagacgtccactccagaccctgtttgcctgggtatcagcagcggtggctgaagaacagcggatattggtgaaccgcaaatgctgctgcctgatcgttcctctggaagttttgtctcagaggagtacccagccgtgtgaggtgtcagtccacccctgctggggggtgcctcccagttaggctactcaggggtcagggacccacttgaggaggcagtctgcctgttctcagatctcaagctgcgtgctgggagaaccactactttcttcaaagctgtcagacaggtacatttaagtctgcagaggttactgctgtctttttgtttgtctgtgccctgccctcagagagggagcctacagaggcaggcaggcctccttgagctgtggttggctccacccagttcgagcttcctggccgctttatttacctaatcaagtctcagcaatggtgggcgcccctcccccagcctcgctgccgccttgcagttcaatcttagactgctgtgctagcaatgagcgagactccatgggcataggaccctccgagccaggtgcgggatataatctcctggtgtgccattttttaagcccattgggaaagtgcagtattagggtgggagtgacctgattttccaggtgccgtctgtcacccctttctttgactaggaaagggaattccctgacctcttgcgcttcccaggtgaggcgatgcctcgccctgctttggctcgcactcggtgtgctgcacccactgtcctgcacccactgtctggcacaccccagtgagatgaacccggtacctcaattggtaatgcagaaatcacccgtcttctgtgtcacttatgctaggagctgtagactggagctattcctatttggccatcttggctcctcccccagatcacacacttgtgattcttgctggcattcacacttactctctctttattttttgagacagggtctcactttgtcatccaggctggagtgcagtggtgccatctcagctcactgcagcctccacctctggagctcaagggattcgagtagctaggactacaggcgtgtacctccacccctggctaatttttgtattttttgtagagctggggttttgccatgttgcccaggctgatctccaacacctgggatcaagcagtctgcccaccttggcctcccaaagtgctgaaattacaggtatgagcctccatggctgggcacttactgtctttttaattatcagcttgcaaatgagaaatctgcccaaggagcctgagcttggtgaatacaagttcatttcagccccattggtgagtttatgattctatgagactttaaagatgtattttatttggacatgttaaaaaaaaaaaaaaagaaccgtgtgtttcttcacaacatccaaaataattattttattggtattgataattattattgaggaatagggaagtcatgtatgttatcaaccacttcctaaatgatacctagttaacacgttaggggagggaatcgaatctgaaagtgatacccatttagtgaagccaagcaatgtagcaagagttgagaaaaacttataaagggacctcttagcccatgtccataacattgtcgttaacataaagataggttgccagagaaagggtaactgtatggtcaatttagccaggtctgaactctcaaaaatcaagcactctcattctgttagggtgaagtcagagaaaagaaccttcacaaggtttgaaaacacagttgtaacatactgggctgtgttccagggctagcatttgactctgatttttatcttgtgcttagaaccagcctactgttgtctctgtgcagagagagtactaagtaggtactgaataatacttgctgtccagcacatagctctgtgcagaacgagcactaagtaggtacttaataatgcttgctggccagcacatggatggatcatgtttataagtgtgtatcataaacactttgccttgaggaaattgttttctttttagagttttcatactgtggacatccttaaaaagcccagaaaatgtatctttatggattgacatgtgacttcttacatatgaagttagaagccaatgaaatgctgttctttggactgaactttcaagactcatgtgtgtggtgtctaattcattaactaaaaatatgattcatatttaccttatgtaggactacaggtatccacatatccaccattaggatattctttaaatctggtagtttggaagatttccagacattgtaaagagtaaatgcatcagaaataagcattttccagaagagggaggtatgaaattgtaatgattagcctgttgcttagtcctggaaatgtgaaatcagataaaaatgaaaaagatgctttccttgcattctcttccagaaatatgcagcctgctgctcttttgtcttcagtgtgaccatgctgccctgaggagagcccagaactgtttttaaattcaaaaggacagctgctttctgctcactcaggtccactgaggcatgctccaagacaggaaaaaggtgcttagcggggctctttgatagagattcaatatatgaattttactttgagaataaaaagctcacccacttttaaaaggttaatcaaaagctcattgtagtgtattcttcctttcctatgcagtttcctatggaaatggaatcagtttaaattctggcctcagaacagcaatatttttcacagaggcagtccttctgccaagtggctctagaagtacccgtaatatccatgtcaggagtatgaaaaatgaaagggatgaacacttccttcagaaattatacctttgattcctttactttacggccaggcaggaagaatcctgagagaggtctttactgaaagttcagtatttatgaactacatactgaaaaatgaaaaacgattcctagcactgagttgcttaccctgtcaagtttacccattattttcaggctgttgagcattgtttgaaaaatcgatctgagagctaaatgagactctgtcccttaccatggtcttgctgttataaattcacactgggctatttccattccctaagtttgctttgccctttcctaccctttacctctatggtcttccatccggtaaattttctctcacccttcctggtctagctctatttcatcttcacttatgaaggcttccttgttttccttttttagaattaattgctaattcctcactgctctctaagcattaatacccccatcatagccttcatcataatatgttttgtgctgtagttatttatgtacttacttgtttttcccccttctttgctctttgattaaatgcatgccagatccaactttacagatgagaaaaatgagctctgaagttcaataacttgcccaaggctacccagttagaagagttatggacttcactctgaatatggtgacttttgttctagtgtgttgccttctctagtcttcttaagaaaaaccttgtcttcttttcttttttccttaggttgacttattctatacattagaagtttctaaattttaatcaaactgtcattccagggtcatagtcagccacatgtaaatcagaatgcagttttacatagattcattattactgtgcatggagattagaagccagctcacaagaagacttaatttggaaagatatgtaaccaacttcacgtaagtgctagcctttcattgatttctcacctccattctatattcctcctggcacttgttttaaatctgttctactgaagtccatactctacccccttgctctcagccgatgatctgtttacctgctctgagaagatttagatcagtagttctcaaactttaatatgtataaaaatcacatgcagagctctttctaacatagtttcccgggacttttcccaggaattctgatttcagcaggtcagggtggggctcatgaatgctccattctaacaagctcccaggtgatggcaacacagctggtctgaggactacactttgagaacctctgatttaggccatcctctgcaataggatgtcttctccaatacatcttctctggatatttatccttcctctccttctatgagaattcagtcgttctattctcaggctgaaccctctcaccacgagcttttatcccatctcatttcatctatttcaggaccttgcttcaacttggctctctttgaatcttttatatcaccctctcaattgctttttattctctactgctttactaataaaactgttcctttctcagttgtactatttaagatacatctaatgattgtaagcaaaattattttctctaagaatggtcgacaatttcagattcaactcagctggctaggaactaagtttctgtaatttgggaattggcttgtagagagcaaaattaagaaaccaagtttggccgggcacggtggcttacgcctgtaatcccagcactttgggagtccgaggcaggtggatcacgatgtcaggagatcgagaccatcctggctaacacggtgaaaccccgtctctactaaaaatacaaaaaattaaccgggcgtcgtggcgggcacctgtagtcccagctactcgggaggctgaggcaggagaatggtgtgaacccaggaggcggagcttgcagtgagcggagatcgcgccactgcactccagcctgggcgacagagcgagactccgtctcaaaaaaaaaaaaaaaaagaaaccaaatttaactttttttaatggatgtgagtggaagagactaatgagataacacaaaagagttaacttcttacatttctgtagtctaatacgagatagtttctccaggaattaacacagcacatctggttcactgacctgagtttgtttcctggtgaggcattgcagtatcatccatatctcaggcaaaggtactccagcattttgtagttaagcagttggaggaggagtagggagaactgctgtactttgaaacatttcacagtggactactttgcattctaatgatgttctccttacttaaggactttgttatgtaaggatactttgtccttctgataatcacttacacttttcttctgtgttcatgtcacttcattaatcctgattacttgtaatgaatcataatcttacccacttattcttgtgtgactcattcctacttgtattcttaatagtattttctatgtctgataacacattgtcaattgactatgctatttttaacgtaagcgttggcaaaaaggtttacttagagaaaagctctacatttaattccccggtgcctcagttcccaaatttgctaataaagattatacttagctgtcactccacgtttcatcagtaggattaaaatgaatagagatcatgaaataagacaatgaaaaaagataattataatggaccagattgagaaatccctacaaatcaacagaagcgacctgccatgtcagattcctagatgcagtttatttactcagtgggccatatttcttccttattctttctttttccatgatgccttccaaaactatattttaaccaggagggaaataccatttgtcttctgatataggaagatcctactgagagattatattcatatatttcgtccatcggcctgtaggtggaattgtatttaaaatactaataaaggttattattgcttatatatctaaaaatgctccaactgtccaaacaaagcttatactgttgatgatatttatcagtggctctgaacacttgcatatcataaaattctccctcaaaatttaaccttaaactctttcaggcttgtcttggtcacagtgggaactgaggacagctgctcatgttttttgatagaacagctcttaacatgcttttgctcttgcctcccactgcccaacaccagctgcatacacacagtctacttgctgtgtgcatgctctggctcctgtctccttttccttcagcctagttagcctggttttgtttggtttcatcatacaatgtatctattagtaaaacttttatgaactctgattatagtactaaactcataataaagtaatcagaacttcatttattaaaacactgtcttgagcttattttttaatttagtacacatgacaatttggtaaggtaggaattttcattccccttttatagatgggaaaactgaggtccaggatataggtaacattttcaaagttaactcgtaagtaaatggcttagctggaatttgaacccaggtttctgcaattctaaagcccatccttttaactgctatgctatgcgcacaattactgtattcttatttgctctctgaaatacaacaccttattctcatttcatctgctctttctgccctgtacacttcagtttctgctctatagatacctgctcgtattgtgacatctcaattttttttgtaccttggcagggttttgattgatgtattggtgttctgaactctttagcatatgtattaatagggaagacctaccaaatatttcatgtaatagggattattttgtctacctattttatctttctttataatgtaagtttgtagagggcagaaactataaattgctcagttagggactccacattgagccaagcacatacatacttgacccagagaagtcatcaccatctttatcgccacagctaacatatgggtagtgctcaccatctaccaaacatgtgcatggattattttatttactcttcacaataaccctataaagtagactatgttgccatccccaaggttaaaaaactagcccaagttcatcgagttactgcatgatagagtttgagtctaaccaacaccaatctacacgtctgtcaacacagttaactatcccacacttctcagtggaatctagagttccacttatttcctattccttccattcttcactatatgtcctctttgccttcttatcctgtttctctacttctcactttctgccctatacgtatctgctcaatcttcaatcttctctgccttaccctctctttttcaattttgttctcgttctgtcctatcctgcctccccactcttcttacctcattttcctagtcctcttttcttctttttttcacctttttacctcttacatatttcttttttaaaagtaacttcaagcttgataatagattcttcaacgctcttagcaatatcgtatcctaaccataataaaatgatagtgtgctaggtgtaaacagaagtagaatatgaaattgaaatgaagaatctctttactttttctattagaaacataaataatgagtgactgtaacatcttggtctccataatttctaagtgttaaataaaacacatttctttttttatttaacacacacacatccacacacacataaacttgttttatgcattgattgccatttattgagcagcatatttttggaaatgcaacaactacaaaagaatttttaagttattatcatacagtgacattaataggctcatcactttgccttctttccttgttctatcatgtagagggttgctttagagatcattgtgtattgatatgaattatcattgaagttttattagtctggatgtctcatcttgggcattttgataaatttcttttgctccaaatccagaagttatggccattcatctttataaataagactttttaaaaaaggtaaagtcataaaataaatatttcaaagcagtgttggatatagccagctgaataaactgccctttctagttaactttgaactctaaaccttatttaaatatcctccctttttttctgtaaagaagacgagaaaaaaaaacaatttcagtagattctaaaagaaaatatagcaagaacattttcataagagatatctcacataaaaagctgtaaaaattgggcaagtatttgcacctaaccagtagaacttagaagagaaaacatgaaatgaacttcttagcttatggaatggtgtggataggtttgcattacttagatgttcacagagctctagcatttacttactgaaacactggaatggttcatatccctgtggtttccaccttatttcttccagaaggattaggttttatgctgccagagaccacattgactcttagtaatgggatcactaaattctggttcacaattttgtgcatagagagattgcactaatatctcaaaattgtagctatgattataaccctggcatagaaatctgagctatgctggcagtgtcatgctgtacaatcgaatccacctgattatctctgcatttgtgacagctgggctggccttcattggcatatgcctctttgctgtgcccagggctttgaatgcaaaatgaaagatcagcatgatattaggggcccatgatccatagatggagcttcacaagtgaacagcgtctcagctttaacatggcccccagtatcctgctttatctttctggactgaagttcctatgacagatttgttgctttaaaaaagtaattttgcagatttgtccttttttaaaagaaataaagattgccttccatttcctactgaaagtgatatggtagtatccatcttataattgcacagattcaaaaataagccacaagtatgtgtgctgaagtataactgtggactataaaatacagatatcatagcctataatatggagggtagtgtgatgttataaagccatttttctgtgttttacattatcataaaatttaactactgaagggaaagtgaaggttttaatatttaactaagcctagcacttgaagagaaacacatatattttacttggaaaaaaaggaagttccattttggacactgcaaatgacagtgccagctgttgtcataatatttctaacatccgctgaggattaattccaggcccagcaaattcactggatgagcagaaacagccaaagaagtaaacactggagcttatgctgtgatattattaaattaggcatgagacttctacagagttggatatgtagtgaacactggattatcatgcctgaggatcgtttgctttgtgtatatctgcagaaaattgaatcctgaacttgctttcttctgcctcttggccctcttcctctgtagaggtatactcagaaaatgtgatctcatttgaatataaacttttctattaatattcattaagtactcatacaatataagctgaggaaacaaagtggtgggtgtaaaacacaggcctcatgtaaagagcttactttcactacagaggcaatgtagcataatgaagcagagatgggtttcagaggcaggtagaccagaattcaaatcctacttctcctaagtatggccttgggcccatcacttaaatttctgagactcagtttccttttctatgaaaggtagatactaatcatgctacagagttctattaagaattagaaatatttaaagatacttagaccactacaaggtagctatttttctagaacaggcataccttattgtatacattctatgtttctagaacaggcataccttattgtatacattctatgaaacagaatatggaaagtgctaaatgaaaggcacaatcagagaattccccaggccctcaagaaggaaggcggaatggatgaggaagtctgctgtccaaggggtgggccagagctaaggcaagatttgtgggtgggccttcactaaccaggcacagggagagggcattccaggagcagatgtagatctggccaaggaattaagacaggaatgcaagtggcgttttccaggcaaaagattaggaagttttagatcagcctggatatggagaccttgaatagcaagccgactgaggaatgcatgaaagaatgactactagctggaataagagataaatctcaaggcctcttttctctttcacctctcctcttgcccacatcatggacagatagttctggcttttccttatactctgtttctgtaagcaattttaagaaggcagagtgcataatggtattacttttatgtctgcgtgtgtattgccaccatgaagcctatagttttgcttttcaaactactagattgtgaccttgtaatgatctggcaaaaggctgaatttttaaaagcagtaaatccatatagtggataatattgggaaaaaattagggctaatactgaggaatgagaagattaggaaagagataaataaaatatgggtggtataaataaaaattaaagtgaaaatgtggggaaaggactgcttatgattcaccttacaaaatttctaccttatggggtctgttttcactgtcagttctttctgtgaatgcatgttcatgaagatactgaaggctgtttttctataggcagctggtggttttctgctgtaggcagaagtggttgaggtaatcctagggaggtgatgctgaatggggctgtggttctactttatgtaaggttattatatgtgaaagaaagagtaatttttaaaagtaattaactagtggtagattctgaactaacattagcaaaggttgattataaatcagattttatttttactactgatttagaaaaaatctttggagaaatagatttggaatggttaaatatcactttagggagcacattttggtatcacagcttaaaggtactcttaagagaaagctttacaaatggggcaacctgaaaagacacatttcatgtgcattcaaattcaagataagacccaaagctctgttgccaaggtaaaggttttgagagttaaatgggaatttggaaaataatatgcaaaaattgacttaaaatgtagataagcctacaagtatttacagggtggagacatcagagaatgtaagaaatagtttggatcactaacaggaatgtgtaatgggaagtcaaaatctatgctgtcaggaaaaattcatattattggatagaaactgtattatttggtacatttaagataaaatgaaaattgtgttttcaaagggttacgcctcgcagtggatgagtgattggggcgttttctggtttcagtgattctgtaggcagaaaacagtttttactgccaagtgtgtcagtggaggtggggagacagagaccttgctgtgttaagtgaaatctgttgcttaagaataaagctgggatttctgtagaatggagaaggagtttggtattatcatattatcaaaaataactgctctttgaaaagtagattttttaaagtttgattatcaagtatttatttaaaatactgcctaagtatttaaacactttcaggctctgattttgttttttttacaaaggaaacctatgcctaaaaattattttaagtagttatatggatacatgagctacacagtttcagacctgtgtatatgactttctaagaggtctatggtatccaataataaatgattttatgcagggatttaacacataatgggtcatgcattatctataccttgttaatgggatctatatagagtgatagcagaaaagaaagttaattttaggatcctttaatgcctataaatttagagcaaaagaaatatttctaaaagttcaacttttgtatacatatgcccaatcacaagttttacagacatttttacacgtttaggcctgaaatatttgattccgctcttatttgtcaagatacaatataattacattagtaaaatgcaaacagggcagataagttttccttctttttcctatgctatagtcatgctgcaaaccctccattacagttttttggctgaggtaggtctagatgtctagaggccaactaatacagttttatataatcaacatagggaagtcatttcagagactggcattgagctcttggagggaagaaaatgaaccttaaagcttcttgggaatatccctcactgcagcagagtttatgtgctctaatggatgctccgtaaatgcttgagagaatataagtcccataggttagcatatacttaattctacctatcatggaaacctctccatacattctatagctgaaatattttaggagctcaaaaggagtaacagaaactaaagggaacaccagctccaagattggatttttaggctttctttctagtgtaacacttcccttcctgttgggccatcggcaaccatatcctggctaattagaagtgattttcaggggaaaggaagaggtcataagttcttgcctccctattttccttcttgttgggtgctagtaacttaccttaagaagtaatgaagtcctagtaaaactcctaatattcagaaaccaactctcattattcaaacatgttgaggaaaaaatgtctccttgcgtcctcttctgcttaaaactcccccagtaccatcaagcatggacggatatatgatagtggcagtatccagaagacacaccatctatgtaacaaaccctggaaataaagtatggtataatcctaagcattcgctcagcactcttgcttctgggaatttgctatgagtcagccacaggcatctctgtgtaccttcaagcccagattagcacgtatgggaggataagagagaaagtgtacttcctgaatacatcttgggtagagtaaactaatccttagctaggttgatgacatccttacccagaatttaaaagttcagtagagactcttcttgaaatgttgaatttttatttctgcttgttgccctctatagatgagtgaaatgcaatgaagatattcatggctactataaaaatgcattagttctttttggtgagctacttgactatcagagccaaatatgtaggtagttggaattaaatttccaatttagcatcccccttagaagggtgatggaagctcccatatcttggtatttctctttctgagtatctgctgtctcactgaggcaacatgctagcctccatgttgtattatttcacaggtatagaactaagtgacacattgccaattcccacgccccccccccattttctttgatggaggtagattacatttataaggtgtagatattgcttgaaggtacttgttctttcttataagtaagcaagaaagagagcagcaaataatagctaggaggaagatgtgcccacaccacattcaggccacttagtctatctagtaagatagagtgtttcaggcatcaagcatgtactgggagacatgcatacagaaaaagaacaagcaatagactcctttgagagtgacatggtaggtctgaagagtgaatgtaactttttgtctccatcccctcagtgattcattaattattcattagctgtttttttccaccaggattacaatcattttacctttgcttgccagcctagtgggttattaacagtggttactctatttatttacacattttccttgtgtatgttattcatcctgtattagttcacccccacccctagtcaccattcttttttcttttgtttggcctttcatggctaccatattaccatgtgatcagaaaaaaaatgcactggtgtcagaattaggccaacacagacatatgggatggtaggttcatttgggttggatagagagctgtttgaaacttgtatacacatttttcaatttcaagaagaaacatctgcagtaaaggaagaactgcatagtttgcagtggtctaatggaggtgaactcaggaatctcagatgcatttagctctacaagtctccattatacaaatgatgttgaatgtttcatctcttgctacagattagttttgggccatcatgaaaaactttcctgaagattaagtcaaacttatctatgcatgccttctttggatacatagatccacctttgacagctactctgtccactaattctgtcaagtaggactgagctttcttgaacacctctccttttgttaacaagaaggagaagaagaaaattaaacactcctggcatctgcctggctgtgatttagcccttggtaaaaagtattacaaattgagacggtgccagactgctcctgtgattcatctcttctcctgtcaagaccagttgaggcgatgcaattgggaacctctctagtttgtgaagagacactttatgttggaagcaacagcataagcacaatagtacttaggcattcaaagcagagagaattggttcctcctgattgggtgaacaatcactgcaaattaaggtcaaaagtattgtcaaccaattcagtgtactaggcttcttcatcatttcccatgacttgttctctcttaggagaaggtttagcaaattggagcaatttttttttttaaatcttggtgcagcgttagtgataaaacacaagaaagtttaaggctggatatagcatgtgcatctatatcaagatgaagatccatagagagatgtgcttgatcttgggatgctggatgaaaatccaggcactgtgttgtgggagcctgatttctgaaagttggggcatcattgtttggcttatgacgtttataagtgtcaggtacgtcttgtcccacagaatacttgttatagctgttaaaggacagattgtcttcaagacaactggtacccatgccagagtagggtatattctgacagaaaatccatttactctcatctgtaatttatccccttagttgaaacatgatcccagtgtagggcatttacttttcacactccgtttaaatcagtgtggtttcttcctaccttaatgaattttacctcatttctttgtcttgcaaaaacccagggcagaatggtaaaatttcaaaacaaatctttcacaaggctggaactagacactctgttgggtcacatgcaagttatttgcagaagaggaacactttgcatgtgaataagagaaagcaaagcacttacaccagtattcagtgctcttggggccaggagtgaggggccttccatgtttgcaggacatctgtttgggccttaagttctgctacagccccaagtccttatctcatatctgcctggtgtcctatttttctgcttaaagagtcaaagactgaaattcttatccttgtttcccattcattcctaagttactttagccttcacatggagccaccatgctgtggcccacagagtgtgctattcacttaaacttatttatcttaacctttttgtgaaatatggttgcattctttgactttccttgcttgtcacagtttacattaatcctggaacttttgagtcttaagcgctacatgatagtactctttctaatggtttctaatgttacacgaatgcctctctttcccatttcatccctttctctctgttggttttgactttaagctctctggctgtttcatggcaatgattattggtgacagtattatctattaccaagtgtttcttgttcagttttgcatagtttcaatgtccttttaagcaaggattgccaaactacaggccacctgtttttggagatgccatttaattggaacactgccatacccattcatttacatatcacctatggctcctttctcactacaagggcattgtttagtagttgaaacacagaccttatgtaccttcacctcaaaacctagaatatttactatctgactctttacagaaaaagtttgctgatctctactttgaagaagagaaagtcgtcagatacatacaatgccaaagaactgctggctatgaaagggatattgtagaattctgcaattttcttaaagaatggaaaacattggaaaagagtcacctgtttacaggtgatttgcatttctataggtatcagaataatgtgggtgcttgtaggttggggaaggaatggcaggccttctctctctgtcagtatcttcaggccctgaagtcatacaatcaatggattgcttttcctcttcacttttccattttgccataattttgccaagggggaggttggaagtgggttaatattttgcgttagaagagcatttggatacatcctgataattactttatctcagatattcttagattctctctagtgaaggccacaccttctctgtgcctcaggctggcatggcccaactgtgctacttaccttgggttcctgctgctcagcttaaagggaatctctttcatatgcctagagccttgtttactcagttcaggtctgtaccagttgacaccaagtcaaaaagcactttagacagaagcctgctttgaaagtgctagctagcagcaaataagtctggcttaattctcccttgagtctggagatctgattggaagggtaaaagggagaaagggatgatttatttgttgactggattgactactttatattagtaattatgaggcaattctacccacattatctcatttaactccccataaaaaccctacaagggaggtaatatactttggaaaactgagactcagagaaattaagtaaattgcaaagtccccatgctataagcattatagtctcataagcaaatgtcatgagcttcttctagctttttcttcatgctcacaaaatggttgaaggagatccaagcatcatgtttctagttaaaaagaaggtgcagagtaaaaggcaaaaggcaaacggacaagccaaccaagtttgttctctttcctagatgttctacttggtgacttcagcttatatctcattaatgtgcatcataggattatctctgcaagggaacctggaaaatatagaaatttgtttgtgttaagctgggcaccttgccacctccataaaaatgtgctctataggtacagagcaggagataatcattattaataggcaacttatagtctctgtttcaagaggtcattctggtacctgagaaaattgacaatctctggtctaaactcttacaggcctctcttgccttcatttaagatgaacttgatagaataaagattattgttgttctctaatctcctgggtatgagacagagaggtaacagatggaatgatttctttctggcttccatagcaaaccaaagcatgtgccagtgaagagtggcaactgctacaaatacttagccaaacgtggggaagagtgttgatgctgtaagtctcctagctatgtcgaggcagcaggtgtctctgtagatcagggcagcaatccctttggtaagggcatgaagagggcacttgggactactggattgcatcatcttggcagagaaaaatgtagcatatactggaactctagctgggtagggaattgacaagttgaaccacaagttgactactgttcagtcagcactagcttttatcttccagtcaccattccctgtggctcttcattgatcgtccacaagctccaggcctgggtggtgcctgttgtgatataagaagggaagagtgatggtttccaaaatgtgaacactcatgtgtacagttttcatgttgataatgaaatgctagaaggggaacagctagctgatgcctatgtctttgtccatacctggctacccatgacaaagttgttgttgttgtggttgttgtttcactccaggcacaggcacagagccgcaagagtagaaaacaagaattccatcctgcaaaagaaaactgaatcccccttgcttggtcacttagggaatcaagttcaggagggctggacatgttttctgttgctctgtaataggggctgaaacttagttcaattatggtgcttagctgaagcaccatgactgaatctttttttgagaaggagaaaggagaagattttaaaatgaaatgccataagtgtaacatagtacatatagaggtcacaaacttggaaagcctgtggtgtcttggaaggtcacataaatgtgtgaaacacgccagttgcacacaggcaagcatatgtcccttctagagaaattattgccactgaggaatgctggttctaatctccaccctcccttcccctcccctccactcctgtaaaaaccagaggtttggaattttgcgtgaataactcagtttgttagtgttgacaaccaggcatgacagtagctcatttggaccctttgtccaaatcaggaaacagcagcccttccttcatggcagccctgtagctacgccagtcgagtgtgggctggatttcagcccttactctcctccttagctgagactttgtgccagacacaagctgcccagctgtagacagtgggcccagaagttatcagtgttacatgagcaaaacaaaacatatctacgggccatactcagcccatggattattattttgcagcttctgtagctgcggttaaaacaaagctctggggccagatcacctgggtttaaatctgggttctgcccttcaggcaaatgactcagtatttcttggcctcagcctcctctatctgtaaaatgaagataaatacttgtacttacttaacagggttgttacgaggataaaatcaatactgtggggcaaacacttagctctacagagggtgacacatagcacttaatgttatataataccaaaatcatgtgaaaatctgattttttcacacttagagaatatacagcatataaaatgatgggagagtgcatgtcagaccttcatgattattttctgcttcttggggaaatgcttatgcctctttggtcactgtgaagacagagaactcaaaatagtaagcatcacttactagctggcctactaaggccacaagaacaaatgaagtaaacactctgcttgaaccactgattttgtttgcctgcatgaaacacttgcacaggttgacagctgacatccgtaacaatgacatcctaaaaccattaagaaatgattaaattaagttcagtattatctgttgcaaaagacaaagatgtgtgaggtacgttttagaataacttacaatgaaaacaactaaaaagtgaggaagtttaaagtggtgagtattcaattgcttgagttcatcttctacactggctcattatctggaagctgggccacagagttaatactccatctttaaagactgtcacaggtgtttgcacctaagatgcatcaggttctgcagtaaaaatttggttcctggcactgagacaatgctaggaggagggtgttaacttagtactgaccataatgaaatctgtggttgactgcaaggacctgggttgaaataagactaaatccagtagtattgctccggtaggttcaatcatattcaagtgttcaataatgattataaagaagtgtcaagctgtcatgcttactttaaaacatatccagaaaagagaatccaaggaagtgtatttagttctacctgcatttaaattagcttttttttttatcattacatcaatgtcattaggccctaaatgatattaagagtgtctatgagaccccaaagacaaagattgtcccctaaacttctattcttatttgtttaacatggacttggcccagctacctccaatctaaagcttctttctctagagtaaggtatctcaatctatgcactgttgacattttgggccagataattctttgttcttggggctaccctgtgcattttaggatgtttagcagcatctctggtctctacccactagatgctagtgacttccttcccctcaactcatgacaaccaaaaatatctgtatacattgctgtaatgtcacctggggagaaaatcttcctggtgagaaacactactctagactaagaaaagtagccagatttttaaacacaaaagtgtttttcctcccagaggcaaaaagtgccctagagatggaagaattttgaaaataagctcttccacaaactatactgccaaaatggttagagaaagatcctataatcaccatgcttgacaaatggtgtttttgctaagcctcacagcagctttgttcatgtattgtgttaattgcaattaaataaactagtctagaagtgcgggtcatcatccagcccattcatatccctcctttacagtacacatccagacttctttcagagttttgcttgcccattggtgctcacatataaaaactccgtgggtgggagttagggattcatagagcagagagggacctcagctcttcatgtccacttttcttgttttaaaggacaaggcactgaggtccagaaagtggaatttgcagcacaaattgctatgataaacctcagtgattcagcccctgggatcttcaatgatataggcacagaacatataactattactgagtaaaatgtttaaaattatgttcttatggcaatgttcaaggttttaggcataagtaagacaaagcagagaaaaaataaaaaatatttttcaaattgaaggcttaaaaaattaaggataccctctatgtgccttctgctttaggatccagaatcttatgtttgtttgctctttataacacatgactgtgtaatatcagtcaattgtgactggtaaatttccattaatttgcctaatcatatttagaaattatgcctactaaataaattatggttggaacttgaaaggaataatggcttaaataagtgatttgttctttagtcagaaaaatattctcacgctctctctcataccctcatgaagcactgtcatctccatctagtttataattaaggcaatgggaccaaagtcatcctgttggcacaggatggccatctctgcatccaaatttcttttactaattggagaaaaccactaattgtacattttaaactcaaaatgtctttatgtatatatatatttaaaatatattttattatttttattaatttattaattataattatatttattaaaataataattatttttattaatttatacatatgtataatttatgttttctccatgtggctagctgttgatctaaaggagaaggagcaaggcaggaaaattatcaggttcagtgtttaactgggagatgaggacatcactaaaagaaaggtacagcaggttctactggtatgtacaagttttgattacaaggtgtactcttgccacctggtgtggtgtctcagctaactttagtttctgattaccggggtctctgagacaactctccagggtcaggtatagagctccttttgcccttggcatgttccaaatcgcttccttatgctcaaccttctgagcaatacaaggaaaaattccttgtattggcatgttatgaaggttattgaaatactttaggaaatgcctttgaccttgttttgtacttagaggatgatctcattcagaaatgggtagtgtcaaaatatggaatgtgctagtaaaataagcacacaattcacttaaagaaacaaaaacaagacaagacaaaacaaaacaaaacttgtttgggatgggtgaaaggcatggggctgcaattcatcctggattttaaggttagaagtggttgaaagaaatgtgatatttttacctaaaccgtggtcaactatacttttactttttagcaatgatgtgaatgaagaatggctttgaagactgttggtggatttgacaaatatttatcaagagcctgctatgagtgtcaccattataggtggtagagattccacaatgaacaaaacagagtcctttcttacattttgtgaagggagaccacctctaaacaaatatatatcatgtcaggtagagataagtgccatggggaaaaacaaaatagggtaaggggctaggtggggcaggatcagaccaaggaatttatattttatataagattgtcagggaatgcctctctaattagatgactttttttttaatagaactgaaggacataaaaggacgaggcttatggatatctgggggaagatgtcagaggctgttataaaagttgcaacaggaaactgattaggactcttagcagacttatatgtgcttagaatgaaagggattgggataaaagaaaagaggggagctttgggaaagcattaaactgtggccatagcactgattggataaaccataacattggattatgggtctgcaaatttcttacattttttttaaagtgtcagacccatagccctagtaataagcaacatggtcttttctttgagcatagctgtaatgaacatgttattcttttggagttatcctgcaaagcttatcaaactcaagaagcaatagtttatatgcattgcccaggttgaatattattaatttgggttgggaagtgatatgaccacattctgactgactataggccctagttcagtttacctgattttatgcccaatttttaatgagaagggagcttgctaggccaggcaggaagaaagaaatggggacagtgtcaagcaggaaatgcagaagagttgagtgtaggtaaatcccatctttcctggctttacgttgccttcacatccctcataatgatcttctacctcagtcttcagtataagcagtatgttgttctaaaggtatgaagtcttggccaggcaccgtggctcacgcctgtaatcccagcactttgggaggccgaggtgggtagatcacgaggtcaggagattgagatcatcctggccaacatgatgaaaccccatctctactaaaaatacaaaaattagctgggagtggtggtgcacacctgtagtcccagctactcgggaggctgaggcaggagaatcgcttgaacccaggaggcggaggttgcagtgagccgagatcgcaccactgcactccagcctgagaacggagcgagattccgtctcaaaataaaataaaataaaataaaagtaaaggtatgaagtcttttccaagctaaggcaagaatgctgaaacctcaatcatagcacttttccaaaagagtcttaccttatattctggatctcttcattatctcaagaggggcttctttctctttaaatgtgaaaagaagagaggcatcagctagccctattagcccagggctaagaattgctccagatttttgaatgcttaaccttaaacaaagtcacatgtaccagtggaaagtggctcccctgttttcaaggacaggtcagattttaactacgtgcctcttaggcttgccctgtcttcggagttgttaaacatgcatgttgggagctgttgactgtttttttttttttttctttctttctttttttgccttataatttacttttattttaaatctattatactttgaactgttgactgttagagaaagcagtactggcttaggatcagcagagaatatggttgaattctatttcttaaactgaggagaatttctgtttgagcccagtccaagtcattacttgagcaattttttgcgcattttgctgcttaagtgtttattttttttttgcttttacaagtaattttttttaaaaaagttatcatacactcagcaaacattttttgagcacgtacacaatgcccagccctgtgccatgcatgttcaaaaaaaaaaataggtaacattatatctgtgcttgtgaaattaatacatttgttagaaagataagacttcaatcagtaaagcaatccaagaaggaacaagtacaaatccaggaaggagacattagctcagtggaaagagtccactgaggtaggtagacttgggtttgagtcagaagcaagagattgcttttgtgagatttcgcttatcctgtgtgggcctcagcttcctgttatgtaaaatgggataatagtacctattacattgtcacattggattgctgtgatgacttgataatatttatatacaaagcaaccagtataatgcgtgctcatagtaagcacttattatattattattatttattggacatataattagaaggtctgggttataatcttgattctacaattatttagttttggtaagtcacttaactttatcataccattcatgcatattacctataaagtgaaaggaacagaggttctacaatttatctcccaaattccatggtattttgaaccaaaatgtattgaataagtatttgatgtttgcttccccttcttgttagtgatatttacaatagcaataaaacatcaatatttatttaggacttgctctggagccacgagccgtggtgtgttcttgacattatgttatttactccatgctgcatactcagtgagacagataaccttgtcttgtttcctagatcctaggccatattttatccagtttaatatttctgaaatcagaatgtattatgtagtattatgtagttaataaatatatttaatgtggaatttttttcccaaaagccctttctaagtgagatggaccctcttatgatttaatgaggatgtcttccaagggaaataaatattttttctatatttctgatggtaaagttgaagcatagagaggataatttacatgaccaagattaatgaactaacaaaagcaaattcaggacttgaacttaggtttgttttatttaacaatgctcaccctaccgtacttcttgggagcaaaaaatttaaaaagtttctaacatatattcattagttctttccattttttatagcaaaatatatttgatctgtctctagaatcaatgatagattcactatttgttaacttttaacaggaatatattttagtccctctagcctgactttataggctatgtacccagtacatgaaaatatatagtagcctcagtttaatgttgatgtttatttgatgtcgacatcactagtgacactggtcaagcgtatccttttagataagagcctattagaattatatattccctgtagaaatcttaccttgaccatagtacatttaacagcagatttttctcagactttcaaaatcctgaaagtctgggtcattacaagaaaacaaggatgtggtcataaacagttgattattaagcaaattcattgaaaattaacagcagtattctttgacctcactctttatagccaaactgctaatcttgggtaaattataagattatattactaatccattgacatttagcacaaattagctatcaaatgggtcagttgttactgttggaaacttatgaaaatacattaaagttcttcccatttcctgtatgtttctttctctgacacagaatcttagaggcttttattaggctgggagaacttcccaaataatctaatgactagttgaataattgtttatgatataaaatcagctttgttgtcagaatgattacagtttcagggtcatagttaatagaaaaatatttcagtgaaggttaccattagtcgttgtaagtatcccttgattcaagaagtgaaacttttattgaaaaaactatttgcagagctggagccctgatgggcctttctgaagtttttaaaattaagaaatcctatctctacttttaacaagacatgaatgttagtatattcacccagactaaatgaatgaatgaatgatcacattacacatgcttgggatttgatttccttcctctggtgttcactggactagcagcttcagtactcaagtgcgattgtaaaattacacatggtggaattcaaaatggtgtacatcagtcaggtcctggaaagacacacaatctaactcagaagtttcaagagacttcaaggggaaatgtacagaagtatgggtaggattaaagtagctagcaaggaatgctgagtcactcggaccctagctgccatgagaagctattatctcttctggacctggagctgcagaagaaggaaaccgtgttactctagtcctgagagggccggagccatggaggaggggtcttgtgacagaagctaaagttctggagagacataggctaggccagagcataggaatgtggggaagacatccctgacctctctgtcaaccttctaatctccattgttcaaacccagtaggaagttatccagcattgagcctggagagtcagcccgcagcagtcagcctcctgagtgcagagcagaggaagacctggaatggatatgctataggaggagggccaaacagagagtaactagtccagatgggaaatgctattttagacctcatacactgccaaaaaagaatggcatattcaaggaatccaggaccttgacctcatttgatcttggatttgcatccattttctgatactttcttccaaatactcttgtaagcatctgacagcagccaggagaattgctggtcagttcagcctgtcccagcttcattgctgaggtacatatgtggttaaggagctgagagaactggtctgatagctcaccaaagggggcctttcccaaggaaaataaaataaagagaaaattcattgagaatctgtccagaaaggacagtaagtaggcatggaatcatagtagtaaggaagcatggaggaggcaggtgcataaaaatgacttgtgatatttttgaagctatatgataatgttctgacccacactcttgccagcctctgcaatcttctggaggcttcatatgaaagcaggattggtatgctgtttattataaatagtgagacctgagagatgattactgtcagcataaatggatattacacattgcacctatctcccagcaggaagtttgtttgtttgtttgtttgttttagacggagtcttgctctgtcgcccaggctggagtgcagtggcacgatctcggctcactgcaagctgcgcctcccgagttcacgccattctcctgcctcagcctgccaagtagctaggactacaagcgcccgccaccacgcccggctaattttttgtattttttagtagagacggggtttcactgtgttggccaggatggtcttgatctcctgaccttgtgatccacccggctcggcctcccaaagtgctgggattacaggcgtgagccaccgcgcccaaccagaagtttgtgtttgatgtcactgttgtttcaccaatttaaaagaaaatgaatatttttaaaggaaaagaaaaaagttatcacactatgtgatgaaatttgtatctatgggtggttatttgctacttggtaaataattaaagcctgtactggttacctttcctttagcagctgacaacaaataaacatcctcacctcacaccttatacactttactccatggttcattttcagtattattttgtacttctcttgcttcatcatactattgcctggcaaaattccaacccagatttaatcctgctttccatctataccctgcctacacctgagagttcaatgttactgtggaaaatgcacactgtggtgacttgtttcactttaaatgcatgggccctaacctcactgagccatttattagtaatgattggcaactctccatatttcttgaatccactcactttcctagtctcctggacaactatgtgacaactcctctatcctcaagcctccaacaattacttctcataccctaactctgcgcagataaccttttttcctatttcactgcaaaaagcccagaagtaatcaaaagtgaatctacaagcttccaccaccacatctactcctcccagtctcagtgaccatatggtttgccttccttctgttaacagagagcttctatcaaagatgaacctctccacttggcactttatttccctcttgcatattcaaggacattagctcagcaattttctttctttctcctttcttgcattatttattttctccctccaccagaagttgtcaccccaacttctattagaatgacttaggaagtgcaggcctcaaaccttttttttttttttttacacgtctacctctattagcactccctgctcctattttaggaatccaggctttaacgctaacagttacaaattaagccacaagctttgtaagtatttgcctgtgctctagctgctagtgggtttttggaaaatcagtatctgatgggcatttgaatacatttgctcttgtggctttaaacaatgtctgtacaataaaaacttgagaatttatctcctctgaattctagacatttctattcaactacctagctggcatttccacttgcatgccttaaaggccctcaatcttatctgtactgaatcgatcacccccctaactgcctcatccgtcagttatccccattgcagttggtgacattccatcctttggttgcttgggttaaaaaatgttggagtcccccttgactcctttctttctctcatttcccaaagccaattctttggcaaatagtaaccatttatcacattttccactgctactgttctggtccaagccaccatcctcattcacttggattattgcaaagacctttacctgttctatatgcttttatatttgctcatttttctcccttcacccctattttgctttcagcacagtatatcatctcatgcatctactcaaagccttctaatgccttcccatttcatgatggcctataaagccctttgtgatctggttccctgaaatccttgacttcatttgggcagatgtttctgctataacgctatttatgtgttctgtaaaactttttggtctgcaagatgtactttgaaaaataacaggtcttatggtaaaattacgattggaatagaacactcatatcttatacaacataaaaaactgtagcaataaccaaagcaataatagataccttgggagataacaggaaggcaggcagctcagattgactgaaggcgactcaaggaatattaaaaatgcacaaaaacagtagcatggagatgccggctggggagctgagatgagacagatgaatggagctctgagccagagggcctaccacaaaagtggtcataggaagaagttcagcctgccttgagcagatagctttgcctggtgggagagggcgtatttcttgggagacacctctgggtgcaggcgctcatctttaattcccttaagagagctgaaatcactgcagtctgtgcagcagccaacttcagggatttttcctttcctgctaaggttataattctgttcttgctattcttactcctcttgcctaagaaaaatcttgtttccatgtaataccaatattatcccactatttaccagtagcatatgagctgcttgctgttacagaaacacatgctgtaatagaacagactgcactccttgggtcatctttgttatttcccatgtgtcaggtgagcacccaccttgtgacttttgctactggtctttccctgcctggaatgctttccctccagaagtcctcacggatttcttcttctatttcagttctttatttaaaaatatttttcatagtttgaacctctctaaccagctgatttaaaagaacaacaccaccccaacaacgttctctactttacatcatagtttaattttctccatagtatttatcatcatctgatatattataatactcatgtattggctgaaccacatccataagtattaagatccgtgagggcaagacttgtgggtttttaaacttgttttcctcctttgtttttctctattatatctttagtgtctggaataaggttcagcacatacaaggcatttactaaatgttgaatgaatgaatgaatgaagctcaagctccatctacaaacagtcctctgttttttgttttttgtttgtttgtttgttttttgtttttgttagctgttatctggctgttttttattagataataatttgtcttcctttacttactgattttgtttatgtgtttgcaggtgtgtgtgtgtgtgtttgtgtgaaagaggagaatgacttttatcaaacctggttttatgtcttccttaggatgcatcagagtttcatgctgttcacactacccttcggggtattcagacatttaaagtcttaatatttcagcaataaagtcttaatatttctggcctggaaaaatactgtgatatgggttgaattcatctttttgcacccctctatcatcataaccactccctgctcccattctaggaatccaagctcttatgctaacaattaaaaattaagtccacagactgcagatagaccctacgcttgagctgccggtgggttgctgaaaaattaatatttgatggaaatttgaattaattgcctctttaccccctaccaatccctgtgtatggtcaaaaaataggacattccaatactccacagtgatggccacagtgctggtttgtgctgatgttataaaggagcaggaagatggtaatgaactccctctggtgctggacaaggcttcacaagggtgctgatgaaaacaatgtgagaaaatggactcaggggttctcaaggcagagaatggtggggggatccaggaatccacatattcaaagacacaaagaagtacagatttctgaggtgttcagggaatggtgattcattaggtatggggctgggggtggggcacagggtaggcagaggagagagcagtaggtgtatatgccatgaagattttggaatcgatccaactatacagctatcaaaggtttttggtgatacaaccagattcgtcttctcactccttacctttctcacctgatccctccctggcttttccaaactgtcaactataaggctgtgtgaccagagagcatgcccctgtccccagtactcagataagtgcctgacatatatatatatacatagacaacctacttgtttatgtgtctgaacaaactatcaatattcatttctgcattttcttttcagcaatgcttacactgtcttcaaatcctttagggccctacacttgactatcaggctgcctattgaaaactaactttacaggttgttcattggttaccatgatggcacaagtaaccattcagtaactttttttttttttttaactagaattgaaagctttgatccattctctttttctggtctcatttcccttctaccagatctgattcatggtgcaacttttggtggcatcaccccttaatccagcaacatttttgtataccctgaggttattactttgatgtcctgaacttatggctctgggggatatttttttaaaggggtcagagaaataaggttgaattagagagattcttagaagtttatgattaaaacactatcccctctgatctgagtcccagctctgccattgacaggttgtgtatcattagcaatagcaagctacttcacatttctgaatctcagttgattgagcaaaatttagataatcaaagactactggagatgtgatgctttgacacaaagaaatctacctctttggtgaaatttcaattgtgtaggagcagttatttgggagaaaagtgccctctcaccttcttaaatcatctcctagggctataataggaaatacgcagcttttgctgagaacccaaatgacattgtggattatccagctctagtcttctctctcccatatagaggccggttatctttgtcacttcacagctcattagcagccccactcagggccatggagaggaaatagatgagatgaagcttaaatatgtcacattggttatttcttagcagctctgataaaaggcttagcaggggccaggcgcggtactgtacgtctgtaatcccagcactttgggaggccgaggtgggccgatcacctgaggagttccagcccagcctgaccaacatggagaaaccttgtcgctactgaaaatacaaaattagccaggcgtggtggtgcatgcctgtaatcccagctactcgggatgctgaggcaggagaatcgcttgaactcgggaggcggaggttgtggtgagccaagatcgcgccattgcactccagtctgggcaacaaaagcaaaactccgtctcaaaaaaaaaaagcttcagcagggtgaggttaaaactcaaataaagaggtctgaggattatctgtgatgttagctcatgtgtgttaccttcctgtcttcccttctttgttcttatttctagggattagttgactgcaaacattaatgggttaaatataaaaatgactgcaaacattaatgggttaaatataaaaaatcttttctatcctgaaggtctttgaaaaaatgattttattacttactggaaaagaaaaataaaacaaagcttgcttcacccagaatttattttttcttctagttaaaatgagcaacttctttaaccagaactgaccttgaagacaaatggctaaaataaaacatttgctgaattcactgggcgcatcttacaagtaatttttggattctgcattgactacctacaagtgccttctgggtgcaagtccacaggcaagatttgttctgcaaatcttccatgaccaaggtcacctctttggattggcagacccagggagtccatattgggaagataaattcacacttcaccccttgttgagatctccagccttgctcctctgataaccaggtctctcttctgtcctattataatttatgacctttgaaaagttacttatatctggggctattcaaactcccagctatctatgaccatatgcataaatggttctagatttaaaaaaaaaaagaagctattcagagatattgggataccctataaccaatataaatgggtaattcagcagaaccagatgctggggttgagaaatagatgtggacaattggggcagggcctaagaaagatcggaggcaaagacagtgactagatggggagctctgataaggtaatgcccaggcctgtgcttggaattctgccacagtggggacattagtgggggtctgtagtcattgcagggtgagaggaggatagaaagaaaagattgtgtgaaggtcagtggaaggtcccccatttcattgctaagagaactatgtatgcacgttttcctgtgtttagtctcacacataattgtacctttaagaactgatcacacactgcatttccctggcagtttttggcatctcagatgaggaagagtgatgggcgacaggtgatggtgacaactattaataagatctgaaagtaaacagtctcatgaaaggtggccaggagagggcagtcaccttttatcaggagcacagactgaatttgcaaagggtacttaagctacaagactataaagcatgatgcaggcttaaccaaaatgcagtgtcttgagcatagtagactcttagtgtatgtttgctaaatataccttagctgctgctgttccccagagctcatcagagttccatagaaacctggtcccttccagaaaaccaaagaatgactaaagaaaagtgattgcaaatccagaaagcagctttgccttactggttggtaacagcaggattttcttttccttgtagtttattttggcttaggctagtgtctctttcatgaagacagctactatttacaattgttgttaacatgtttttcctttttcatctcccaatatactctcttcctgtcgttaaacacagtcaatttaccaatggaatctgctttataagctcctgcattttctttttccacagatgggattaatgccattatgttctatgtcatccacatagtcttggcttctaggcaccaaggtgttgttctagaggaaagaagagtaatggtcgacacaggcaggctgagggctaacctaatgatttcatgcatttagtggtaattcttaattaagatcccaattttattctgttggatttagtctataacccgctgaaaatcattcttgaattaacactgggtggatataaaagcagaaagccaaggactttgcactgttctcagctgtagctgtttatttagctggagaaaatttagtgggtggtccaaccttcataaccaggaagaataaaatagaggtgtaaaggccttggtggaaggagggcagtagcaacctttccatttcttcagttttatcgcagcctatgaaattagttccttaggtatgttgatcttgtaggagctagtattttaacatttgctccatcaagttgtttggtttaaatctaagaataagcccactgaaaactattcctaatttgtgaaacgaataacaataatagatgttaatagaaacaaagacttcatttggttagtttttagagggggcacagagaatgtagtaacataataagttagatttttgttgttttctttttcttagttctttgtagtctttataatctctaattggcatttgctcctgacttttctcagtgtacttccacatggaagagacaaaagtctcaaagctggtgtagaaaaacccttaataaattgcccattaattagccaccttgatttccacctttaaagcagttaattgaagtaagaatttgttagatttttctcaagcatagcagaaattaagattaatttcttaggtgtcattgctacttgcctacttaaaccaccagttcatctttatcataaatacttaagccaaaagtcacattagaggcaatatggcacagtgattgtggaccccggagtcaggtgagctggttgaaatcctggcttggctacttcccagctatgtgatcctgggcttcagggttcccttttgcaacatgacatgattgctgagctgcttcttagggttgtgtgtggctccggtaagataatacaggaaaagagctgaaagcagtatctgaccctggagagaaagtagggaagagacaatagaggaaagaggacaaggaagtgggagatgaagagaaagttcaagaaggaaagtggaagaatctcaaatagaaagttaattttcagtttttcctgagaagagatatatagacatcttcatgtggctttggagagccttggagcccatcagcaagacggttggaaattatactgaaacagaagtgtagacctatgtgacttatgtcctggccagttgcctcatgtcctctgtggtcaggttgatctctactggcactgtcaaaagattttttatggacagctggttggggtaaactttgaaacctgattgtttgcacttgagtgccagagtgtgtaattatttaccggtgttcactaaggatgtcagtgtagatttttagggggagaaaaaacttaaatttaaaatttggaggcatctttttcagtctgcctgccctggtgtttgttataacacttagtttggcatgtaacagctgaagctactggttaaatcattaagcatttattattttaaaactcctcttctcaaagcaaaaaataactatcatgttgaagttctttcctctaagaatgacatttactgtgagttttataccaatggactaattggagggttgagaaaataaattttggaaagacaacaataacttcagaattttccttggatggaggtttcctttttaaaacctgaactgagctttatcaaaacagtaactgaactttgaaacgaaacaagagtgctgaattgaaagctccaggaaggcagggatgtgtctgtgttgtttatgactataacctctgggcctaaatcagtacctatcccatggtaggcactcggtaaatactgaaggaatgagtacagtatgaaaattagcatggctgatccttggaaaaaatataagtcaaaagggaatagcatgcatgtgtaactaaaacatcagtccacatgcttgaaatgtcatcacttttttatggtcaggacctgtttttttctgctccaattaaagaagaaaattgtaatgtgaaagaagcaagaagtgaagtatttggtattcatgtgttttgacatctgcagtaagtttaaaataaatttctaaatcttattgtattgaaattgtatgagtttcttaagtggtattattcattcagacttaaagtgaagttaggttgctgtcactcatagtggacttttttttttttggcattattaaaacaacatgtcttctgggtgttgtcttgtattacaaaagcttgcgtgttttctcttgatgctgtgccctgtctgttgccattgaggggtctaaggaccaaatgaggtcttgtttccttcctgatattcttttgaccagtttagaatatgccaggtccattcacacaactaagcggctcagttctctcagttccctggtcttctcatattagattgttatctatgagcttgaagtttagacatgaaaaagaatggttgtaatcctcttccttctctcaccctcttccctttttttcttaagttagccttttgaattcatgattctaataattaatatatattattatataatatagtatatattcataataatgattaatgatagtattaataattctgtgtgtgtgtgggcagctactcatacagaggaaaacagattgattagtggaaattacattaatttcataacttcttattaaaagagtttgtgtgtgtgttgttggttgtttgttccctttgcaactcaacatggtcttcttgaggtgtagggaaaacatatgcttaggaaacagagccttcttttctccttttggtatggaagacatatgcaaaaagaatgaaggaactaattgtctctagccagggctctgcaaaaatagtactggtagagaaaaagctctaaaagaagtaaaagtttatagtgctttctcctggcagagttaacctcatcttcatcagcttttcccctgcctcagagaggcagttttggaatgaccaaagcagagtgcccaacctctctgttcagagttagcgagcatttggatcactctctctctctgcctcagtatgagtggaatattgcatgaccatttctgatttctgccatgagcgcactcggcctagatgaataaatcctccttgaagaaggcggggcattttggcattcacaagaaaccatgttgatatctgatcctcccactggagaaatgtggcaaagtgagaaagactcactctttgggactccaaaaatgtaaacacaagtaagcatgcaagctgaagaagtcacttgaaatagaaaaaaaaagtgttaaactctctgttagtcatgtgactttttcttggtattcgagagccaggaggctcttgtggtctaatctggaaagagtcgctaatcgctgtgtcaccttggcaaattggttgatctccctgtgctggagtgtttagtccagctgctggatgggatgaaagcaagacctcactgaaaccagatgctgtctctctgaaaagatttcagcaataaataatatcgtatatactttgttcctggcagcaaatactgaactgctataaccctctgttttcacttgcttctaaatttctggaaatatctcctttgggcttgaatttttccatgcttgtcttcagcccaaaactttttggaaagtttgaccaaaatttcacttagctgtttttcctgaattatgggagaataagggcaatgcattgtttttcagctcataaattctcatttttcccattattcctcagaaaaatagctgctacatttaaagtgtttagaactagtaaaagaatcttggtatggtaaagaatactggcagaagacaaatttaagtctctcagtatttccttctaactttaaacatgactgcacacaatcagggcacacataaaaagctctgatgtagttttatagatggccaaagagaagattctgcaaattctctcagtaactcatcccaagttaccaagaggcaactttagctaccatcagttgttacctttctcaaccacttgctctgtctgtggatctgatttctaaaaaaatgtcatggttatatgttggcattgaccccttatctacattttaaataaagttgaccatttcttttaggtagccttcatgtgtgatgacctcagtcatatctgctgacctactagactcaaaattcctttacagcagggcctaggtctgtctacctcaccattgacactgtagtgctcagcagggtatgacacatgtagtaaaaactgattgttgaatgaattaaatgaacataagtacagttgtttttgctgcaatttgttcattgatttgtccactaagacatgcatgcatgtattcagtgagtatcactgagtctctactttatgccaggtattggtatgaatgttgtgaatatttctttgctttgatggataacacagaagttttgctgatacacaacaaaataattatattatttgagtacaattactatgcctatagttggaatattagtccaatatagctaaaggcaatcccagggaatttatcacttactgagcgtccatgatgtgcctggccctgtgttaggtactgagaagagatcaattagacagtttctgcaggaagtcacacataggttaacagtgccaagacaaatcctaaagtacctattatacaaggggaactataataaagagccaggtgagttgaaggcaggagaggtatcattgtaccacaagataccttgtgatcttgtgtaaatcccctgaacaatcaggaaaagctttatggcatagctttatggtcagagatctcatggggacaggcagttagttgcaatgccttttatagccacatccttcactccttaaccctgcactgtctgccattcattctctctgtgctttcagccttgagaagctggccaaatttctcaggactggaaaataaactggaatgacactcaggcacttgatatcaagattattagggtcatgattgtgtttaagaccctaagacctcttgatgcttttacaagaatgggtactttttttgtccctgttttcttcttttgccccaagtttcaagagcatgttacagcagcagtataagcatacacaatcaaaggtgattgaagtgaggacaactggctcaatgagctccagccacttcaactctcctcctagtccctgtccccttgcccggaatgcttcaccctcagactttgacatagcaggcttctttttgtcattcagatctcagctcaactgcaaggatttctctgacctgaagttacatatgtgtcaccccttctggtctccgttgctctctatcacatcacctattggactacctttatagcatttatctccacctgattgtgtccttttcactgtttttctttaaactttttattgtcaattttctttcactagatgccagttccatgaagtaggaaacctttaccactggtcttgagtgctcttgaaagtgtacgtgtgcaataggcactcaaaaatgtttatggaatgatcagctggatgcgtatatggcaagtggcgagaagccaagggaataggacaagagtcctattgtgctccttgcctgaagaaaacctcttgcaagaatcataggctgttcttgagggtgcctttgccttggattcgccaaaaattcttctgtttcttttgtgtgaaaattttcccctcatacacagcaatgggcactaagaatgcatatatccagacttttcaggttacaggatggcatctcagatatagtcttcctttgatctatatactatgaagccataattgcttagccagtatctttttcaggatttactccatatttcttattctaggcctttcaggtggcagctgcactggctttcagatataatttagaatttagtttcggatttgtaaagctactcatgctgcagatcttctctgaaacatttctgtcacattttagaaagctttacattttcatctgctaacgattttcatctgccaaagagcccatctacttaaaaagcagatcactgaagccacacttggcacatattactttggcttattttcttttgatttttttgctttgctgggattacttatttatgaagaaagagagaatattgacttcttattttagaagagaggatattacttgggttgagagttctagttatataaaatgtatttatctaagttgttaactatatcaaaaatggagcagtcaatctttggaaatagttcagggtgaaatgtttttagcatgttcacatattctctttgctgtttttaaataatttggcaaagcttatttgcatttcccaaattaacaattttggccaagaggaaaagctaaagtgttggtttttctcagctcaactttttgggtgtaattaatttataagcaagattttatgaagggagaacagataggacctttctacaaagtccctgagccaaaataaacaccccattgttccatcgttttgtattgcacataggaaaacatccatccctatcattattctgttaaagggacacagattaccagatttgtaattttaaaaaaggccatttgttgattgagccactttgcgtataaagggtggtatatgttgcctgccgaatttctgtacaagaaaaaaatcatatatcaaaaaaatttttctcattcatcatataagaaatttatgcattttagtatgtaccagaagaaatggctttggcattttctgtttttagcagtctgttgaaatttcttcattaaagacattttctgtttgaaggttaaaatgaccatataaatacagattaattcagttttaataggtgcatcttcctgtcatttaccactttctctcctcaatatcagctacagtgatcaacatatatttagcagtgaaactgatatattctgtttatcttcaaatcataagctttttgtttaaatacaaaggaaaatcttatacctctgattttaatatgacaaatcaaaaagtccacaccaaactcccaactcatcccaaaaaagagattgctatctactcatcactgttctctgcttctaagatttgtttcccttggggttactgtttgagcaacttttcttacttccaagattgtttttgtggttttaagaaagaatctgaattccaagattatttttctggttttaagaaagagtctgaaaatctagagattacttaccttgtggtgaggtggttgtctatgcttctgttcaacaaaggcctcatgtactgaatggaaaaaaagcatcaggacctataattttctaggcattatgcaagataatagaggagacaaaaatgatgtcttgcttcaaagtcttagatctatttccctttgggggttgaggaatgagaaagagatttttagatgaaaaacaggaagcccaatgaggacgtgtggcaatagttcctaaaatgagcaaagagataaatttactcttttatatgattacaaccaaatcacacactggtgagtttcaaaacagtagttttcatttagaaagcaaattaagtggaataattcaactgagtttcactgcaatgggattcattctagatggttcaactctggaattagaaacaatatctaaggatgttgctgatagtagtcagcagataaataccagtaagtcgtatacaggtatacatcattttattgtgatttgctttattgtgttttgtagataattgtgtttttacaaattgaaggtttgttgcaaccctgtaacgagcaagtcttctggctccatttttccaatgacttgtgctcattttgagtctctgtgttacatattggtaatccttgcaatgtttcaaacttttttattattattatatctgttttggtgatctgtgatgagtgacgtttgatgctattattatgttgttttggcacaccatgaattgcacccatataaggtggggaacttaatcactaaatgttgtgtgtgttctgactgcttcactgaatggctcttcccctatctctctccctctcctctggcttccctattccctgaaacacaacaatattgaaattaggagcgttaataatgctacaatgacctctacgtgtctgatatggtttggttgtgtccccaaccaaatctcaacttgaattgtatttcccagaatttccatgtgttatgggaggcacccagggggtggtaattgaatcatgggagccagtctttcccatgctattctcatgattgtgagtaagtctcactagatctgatgggtttatcaggggtttccacttttgcttcttcctcatttttctcttgccaccaccatgtaaaaagggccttttgcccccagccatgattctgaggcctcccaaggcatgtggaactgtaagtcccattaaagctatttttgttcccagtttctggtacgtctttatctgcagcatgaaaacaaactaatacagtaaattggtaccagtagagtggggtattgctgaaaagatacccaaaaatgtggaagtgactttggaactgggtaactggcagagtttggaagagtttggagggctcagaagaagacaggaaaatgtgggaaagtttggaacttcctagggacttattgaataactttgacccaacagcctgataacgatatggacaataaagtccaggctgaggtggtttcagatggagatgaggaacttgttgggaactggagaaaatatgactcttgttatgttttagcaaaaagactggcagcattttgccctagagattcatggaactttgaaagtgagagatgatttagggtaactggcagaagaaatttctaaacaacaaagcattcaagaggtgaatgcttgggtgccattaaaagcatttcattgtgaaagggaaacagagcataaaagttcagaaaatttgcagcatgacaatgcagtagaaaaggaaaacccattttttgaggagaaattcaagccggctgcagaaatttgcatgagtagcaaggagcctaatgttaatcccctagaccatggggaaaatgtctccaggccatgtcggagaccttcatggcagacctcccatcacagacccagaggcccaggaggaaaaattgtttttctgggccaggcccagggtccctgtgctgtatgcagcctaaggacttggtgctctatgtcccacctgctccagctgtggctgaaaagggccaacacagagctcaggctgtggcttcagagggtggaagccccaagccttggcagcttccatatggtattgagcctgtgggtgcacaaaagtcaagaactgaggtttgggaacctccgcctagatttcggaagatgtacggaaatgcctggatgcccaggcaaaagtttgctgcagagttggggccctcatggagaacctgtgctagggcagtgcagaaaggaaatgtggggtcagagcccccacacagagtccctgctggggcactgcctagtgaagctgtgagaagagggccactgtcctccagaccccagaatggtagatccaccaacagcttgcactgtgctgctggaaaagccgcagtcactcaatgccagcccatgaaagcagacaggagggagactgtactctgcaaagcctcagagtagagccgcccaagaccatgggaacccacctcttccatcagcgtgacctggatgtgagacatggagtcaaaggagatcatttttgagctttaaagtttgactgccctgcggcatttcagacttgcatggaccctgtaatcctaatcctattgttttgtccaatttcttccatttggaacagctgtatttacccaatacctgttgtatctaggaagtaactagcttgcttctgattttacaggcttataggcagaaaagatttgccttgtctaaggtaagactttggactgtggacttttgggttaatgctgaaatgaattaagactttgggggactgctgagaaggcattattggttttaaaatgtgaagacatgagatttggaggggccagggccagaatgatatggtttggctgtgtccccacccaaatctcaccttgaattgtatctcccagaattcccacaggttgtgggagggacccagggggaggtaattgaatcatgggggccagtctttcctgtgctgttctcatgatagtgcataagtctcctgagatctgaggggtttatcagaggtttctgctttcgcttcttcctcatttttctcttgccgccaccatgtaagaagagtcttttgcctcctgccatgatttggagggctcccatacatgtggaactgtaagtccaattaaacctctttttgtttccagtttcagatatgtctttatcagcagcatgaaaacaaactaatacagtgtccaagggaaaggaaaagtcacatgtctctcactttaaattaattaagcttagtgaggaaggcatgttgaaagccaatataggctaaaagctaggcctcttgcaccaaagagttatccaagttgtgaatgcaaaggaaaagttattgaaggaaattaaaagtctactccagtgaatacataagttattaaaaaaaaaaaagtgacacagccttagtgctgatatggagaaagtttgagtggtctggatagaaaatcaaaccagccacaacattttcttaagccaaagcctaatccagagcaaggccctgactctcttcagttttatgtaagctgagagagaaagctacagaagaaatgttggaagctagcagaggttggaaatttaagaagccatctgtgtaataacataaaagtacaagatgaaccagcaggtgctaatttagaaggtgcagaaagttatccagaagatatagctaagatcagtgatgaagattactaaacaacagattttcagtatagataaaatagccttctattggaagaatacgtcaatagaagatctaagactttcatagttagaaagaaaaagtcaatgctgggctttaagacttcaaaacttcaaagggaaggctgatcctttttttatgagttgatgaagttggtgactttaagttgaagccattctccccagccttgctagagaaaccaaaagtcaaattcaggaaatacagagaacccctgcaagattctacacaagaagatcataccccagacacataatcatcagattttccaaggtcaaaataaaagaaagaatgttaaaatcagctagagagcaagggcaggtcacctacaaaaggaaccccatcgggccaacaacagacctctcagctaaaaccctataagccagaagagattgggggcctatattcaacattcttaaagaaacaaatcttcaaccaagaatttcatatccagctgaactaagtttcctatgtgaaggagaaagaagattcagagaagcaaatgttgtgggagtttgttagtaccagacctcccttataagagatcttgaaaggagcactaaatatagaaaggaaagacagctaccatctaatactaaaacacacttaaatacacagaccagtgacactataaagcaaccacaaaagcaagccagcataaccagctaacaacacaatgacactatcaagttcacacatatcaatactaaccctgaatgtaaatgggctaaatgcctcacttaaaaggcacagagtggcaagctggataaaaaagaaagacccaatggtatcctgtcttcaatagacccatctcacatagcctcaaaataaaggggtggaggaaaatctaccaggcaaatggaaaacaggaaaaagcaggggttgcaatcctaatttcagacaaacagactttaaaccaacaaagatcaaaaaagacaaagaagggcattacataatggtaaacggttcaattcaacaagaagacctaactaccctaaatgtatatgtacccaacacaagagcactgtattcataaggcaaggtcttagatacctacaaagagacatagactccctcacaatattagtgggagacttcaacactccactgacagtattagatcatcaaggcagaaaattaacaaagacatttaggacctgaactcaacattggactaaatggatctgatagacctttacagaactctccacctaaaaataacaaaatatacattcttctcatcaccacgtggcacatactctaagattgatcacataattggaaacaaaacaatcctcagcaaatgcaaaagagctgaaatcatacaatttcaaaaatcagagggcccttaagaattatgctaaatctactctgtctatactctataaatggaacacaatacatgtgtaatagtacacctgtttacagtatggcttgctgaatattttaaggccacagttgagacctcctgcacagaaaaaaaagatttttttctaaatattagtcctcattgagaaagcacccagtgaccaaagggctctgatggagatgtacaaggaggttaatgtagttttcgtgcctgttaacacaatgtccattctgcagcctatgtatcaaggagtaattttggcctttaagtcttattatttaagaaatacatcttgtaaggctatagttgccatagatagtcattcttctgatggatctaagaaaaatacattaaaaaccttatggaaaggatttaccatcctagataccattaaaaacatttatgattcataggaggaggtcaaaatatcaaccttaacagcagtttagaagaagttgattccaattctcatagattactttgaattgattcaagacttcagtggagaaagccgctgcaagtgtagtggaaatagcaagaaaacttgaattagaagtggagcctgaagatgtgactgaattgctacagtctcatgataaaacttgaacagatgaggaatcacttcttatggatgaacaaaaaaatagtttcttgagatggaatctactcctggtgaagatgccatgaacactgttgaaatggcaaaagatttagaatatgacataaacttagttgataaagcagcagccagatttgagaagattgactccaattttaaaagaagttctgtgggtaaaatgctgtcaaggagtatcacatgctacacagaaatcttttatgaaaggaagaatcaatcagtgtgtcaaactttactgttgccttattttaagaaattatcacagccaccccagacttcagcaaccaccaccatgatcactcagaaggtgtcaacattgagacaagactctccaccggcaaaaagattatgactcactaaaggctcagatgatgattagcatttttagcaataaagtatttttaaattaaagtatatacattgtgctctttttagacataatgctcttgcacacttactagactacaacagattatacacgtaacttttttttttttttttgagacagagtcttgctctgtagcccagtctggtgtgcagtggtgcaatcttggctcactgcaagctctgcctcccgggttcacgccattctcctgcctcagcctcccgagtagctggaactacaggtgcccaccacaatgcccagctaattttttgtattttcagtagaaacggggtttcaccatattagccaggatggtcttcatctcctgaccacgtgatccaccctcctcagcatcccaaagtgctggtattacaggtgtgagccaccgcgcctggccagacataacttttatatacagtaggaaaccaaaaaattgtgtggcttgctttattgagatatttgcttcattgcagtggtccggaactgaactgcagtatcttcaaggtatgtctgtattcaagtttatattttgacatacattcttctttacttgttaaaatcatggtcacctcattattatatgactgatcagaatttgcagggttgctttgaccatataccattgttctacaactacgcagatgtctgagtcctaaaggtgaatctgtctggccagttctgggtttaacggcctatataaaaagtagatgttacacaccttgtataactgaagcgccctatcacggacacagcttaactcttgggtgggtcacttagtctgcttggttgaggtttcagtgcttttcacatctacagaaatgtcctatttgtctaaggcaattttatgaagtaaatttactcttgtcatcctttccaacctgaaaatagaggatatataatttttagcattccattattacctaggggatggtcttcagtcattcttccctgaatttattacactggccctatcttcttcacctgaaataagttaaatgtagaattagcactaaagagaaatagaatgaacttcttccggaatgggaataggaaatgaaagagagtaaatcagaagtgaatcacttcttttttttttttttttttttttttgctttgcaaatctatatttttttccagctttatttaggtatgatcagcaaataaaagttgtatatattcaaggtgtatgacatgatgatttgatatatgtgtacattttataatgatcaccatgatcaaattaattaacacatccttcaccacacagttaccatttgtgtgtgtgtgtgcaagaggaggtaagggagtttaatcatttttgaacactagctacaacataattcaattaaaattctgagaaagaagaaaaattgtcatgcagctgtttaattttagaagcattaactgacaaaatccaagtcttatgatgaatactcagtcaaattttcatgaatgaatgggagcctttacctctgaaattgttgtcatggaagaaaacactaacactgtcttacacagtaattcaagttaccaattgagttaaagtagcaagatgagccatggttgtaattgagaatggcaactatggtgttcttatctaatctgctacctagtttgcctttttgctctaaaatggtgactatgttagaattcaaagaataaaaggcctttatcctttcaggggaaatacaagtaacaagcttaattttttttttcttaacactgatgaaactcatttggggctgtggaaattgctgctagcattgaacctcttattaacattcaaggtgtgccagttttgcacaagctgtgtcatattcagagatagattgttggcacaaactaaggcacttattctcttgttttttcacttctttcaataagaacagataaatatactatttctagataagcagttgaaactgttctgctcatctctttggaataggtttgtgggggtatcactgtatgacatgccgaagaaatatacaagggaaatgctcccgcatacattgagatataaatgaatgcctattttagaatacgtcatttcttaaaagtaaaataagttttggctgggcgcagtggctcacgcctgtaatcccagcactttggaggccaaggtgggtggatcacctgaggtcaagagttcaagactagcctcgccaaaacagtgaaaccccatctctactaaaaatacaaaaattagccagacatggtggtgtgcgcctgtaatcccagctactcagaggatgaggcaggagaattgcttgaacccaggtgatggaggttgcagtgagctgagatagcaccattgcactccagcctgggcaacagagtgagagtccatctccaaaaaaaaaaccaaaaagtaaaataagtttttaaagtcactgattctgtttctaaggaattctcagctggggcttctgagtcaattctcgatggttagaacttatgagtagcagaaaaagaaaactactatggattttctctacaatgatttgagacagtgaatggggctttctggcaggttagcagttaggaactcagatgaccatagacttttttttttttagagtgggtctcggtctcactctatcacccaagctggagtgccgtggtgtaatcatagctccctgaagcctcgacctgggctcaagcaatccacagatttttgaagttcaccctggattgttgtgttctacacagaggttccaccttttgctgccttttatggttactatattattattttgatgtttcttaaccagctgaatcacattgtagtatatgaaatatgttttggctcttgttttaatggttatttgctagcagatttcacaatggcccaatgaaacaacccattcattgctatttgttgcaattcatggtgactaaacatgactccatggtacggctcaccaaagtcttggtttatgtgtgacttccaggggagagagattgagaaccatctgttaatcattttgtccctaaactagagtttttcaatggagtacttgggcagttgaattagtatgtttctcgtaggctagtgagaaaaatagctttttttttttttggcattaatcagactgctgacccacatctctgggaatacttgtgacaagatccagcctgacaatatcacatatgatttgcttttcttcttggaagggacacattgtggcttttctctggaatctgtgaagaaaatgctcctgagcctagaaactggaactgagaaagctcttcctgatcatataacaataagtcttgtgagggtcaacccttgagccatgagggcagcttgaaggaacatggggttgagagtcaagtcatcagaacttctgtttatttttctgtgtaatatttagggacttgttatgtttaactctaggcaaaggtatagatttggaggtctttgatatagatgatagatagatagatagatagatagatgaaatatattttagcatacaaaggaggctacaatacacactcatgtacctgtcactccaatgaattcatcaaatgtaaacattttccccaaatctgcttcttagctgttattcgtaaagaaacaaattgtacagaaaaatttgaaggcccccgttttaccttccccagtctcattattttctctgccaccccagagaaaacaactgtcttgcataggtatttatataattctgttttatactttgccacttttactacatatatgaagcatgcttgttacatacatgaacataaaatatacatgttttactgtaagtgtggaatgtattctagaatttgctacttttactacaaatattttattttcagaatttacccttgttattatataaccctagttcattttttaattgccatatattactccatcttatgaaaataccacaatttatttattcccatactaatcagaatttgaattgatacaatttttaattaaaattaataatgctgaaagaaatgttctttttatacatttccctcagggtgcatgtgatagagttcttctcacatatatatcagtgtacttgctgtgtcttaggatatgtacaattgcatgtctattagatatgccaaattgctctgcaaagtactcataccagtttccactcctaccagcaatgaatgagaactttgtttcgcaggtcattgccaacacttgattattatcagatttaattatttgccagttgatggatgtgaattgctctatcactgttttaatattcattactttgattatttataacattaggtatacttttcatagggccatttaaatttcctctcatctgaattgcctatttctcctcttcgttgattcttctattatcttttcttctctttattaatttatagaaatgtatgtgtgatcctaatatgtgtcataatatctatgttcatatttcatatataaatataatgaaatacttgtctctgttatatataggttgaaaagtttgctccctatctgctgattgcattttaattttgttcatggcatcttttaacacacgtgatttttaattttgatatagttaatattttttattactctagattttgagaattgctcaagaaatgactttattttgcatagtcatatgctctaatttttttaatctacttacaatagttttatgttaaatatgtcaacctttgtttcacccggaattttttatatgtatggtataaagcataaatcaattttttttactattgagaatgcttttattatattatatcttattctattctatttttatttttccataagttattggggtacaggtggtatttggttactttagtggtgatttgtgagattctagtgcacccatcacccaagcagtatacactgcaccatatttgttttcttttatccctcatccccctcccacccttcccccaaagtccccaaattccattgtatcattcttatgcctttgcatcctcatagcttagcccccacatatcagtgagaacatatcatgtttggttttccattcctgagttacttcacttagaataatagtctccagtctcatccaagtcactgccattaattcattcctttctatggttgagtagtattccatcatatatatatagtatatgtatgtatatatatgtacgtatgtatatatgtatatatgtaagtatatatgtacgtatgtatatatgtatgtatatatatgtacatatgtatatatgtatgtatatatatgtacatatgtatatatgtatgtatatatgtacatgtgtatatatgtatatatgtatatatgtacatgtgtatatgtgtatatatgtatatatgtacatgtgtatatgtgtatatatgtatatatgtacatgtgtatatgtgtatatatgtatgtatatatgtacatgtgtatatgtgtatatatgtatgtatatatgtacatgtgtatatgtgtatatatgtatgtatatatgtacatgtgtatatgtgtatatatgtatgtatatatgtacatgtgtatatgtgtatatatgtatgtatatatgtacatatgtatatgtgtatatatgtatgtatatatgtacatatgtatatgtgtatatatgtatgtatatatactatagtttctttatccactcgttgattgatgagcatttgggttggttccatgatttttcaattgcaaattgtgctgctataaatgtgtgcaagtatctttttcttataatgacttctttcctctgggtagatacccagtagtgagattgctgaatcaaatcgtagttctacttttagttctttaaggaatctccacgctcttttccatagtggctgtactagtttacattcccaccagcagtgtagaagtgttccctgatcaccgcattcatgccaacatctactgttttattattattttttttattatggccatccttgcaggagcaacatggtatcacattgtggttttgattgcatttcccttatcattagtgatattgagcattttttcacatatttcttggccatttgtatatcttcttttgagaattgccttagcccactttttgatgagattgcttgtttttttattttcttattgatttgtttgagtttgttatagattccagatattagtcctttttcagacgtatagattgtgaagatttttctcctactctgtgggttgcccatttactctgctgactgttccttttgctgtccaaaagctctttagtttaagtcccaactatttatcttttgtttttatttcatttgcttttgcgttcttggtcatgaaatccttgcctaagccaatgtctagaagagtttttccaatgttatcttctagtatttttatagtttcacgttttagatttaagtccttaatccatcctgagtagattttttgtatgaggtaagagatgaggatccagttttattctcgtatatgtgactagccaattatccaagcaccatttgttgaaaaggtgtcctttccccactttatgtttttgtttgctttgtctaaaatcagttagctgtaatatttggatttatttctgggttcaatattctgttccattggtctatgtgcctattttcataccaataccatgctgttttggtgactatggccttagagtatagtttgaaatcaggcagtgtgattcctccagatttgttctttttccttatttcttgctttggatatgcaggctcttttttggttccataagaattttagaattgttttttctaattctgtgaagaatgatggtggtattttgaaggagaaggttttgaatttgtaggttgcttttggcagtgtgatcgttttcacaatattgattctacctatccatgagcatgggatgtgtttccatttgtttggtcatctacgatttctttcagcagtgttttgtagttttccttgtcaaggtctttcaactcttttgttaagtatattcctaagtattttattttttatttttttggcagcaattgtaaaaggggttgagttcttgatttgattctctgcttggtcgctgctggtgtatagaagagctactgatttgtgtacattaatcttgtatctggacatgttgctgaattcttttatcagttctgggaactttctggaggattcttcagggttttcaagttaaatgatcatatcatcagcagacagtgacagtttgacttcctttttaccaatttggatgctctttatttctttctctcatctgattgctctggctaggactcccagtactatgttgaagaggagtggcgagagtgggcatccttgtcctgtcccagtttccagagggaatgctttcaacttttccccattcagtattatgttggttgtgggtttgtcataaatggcttttattacattgaggtatgccccttgtatgccaattttgctgagagttttaatctgaaagggatgctggattttgtcaaatgctttttctgcatcttttgagatgatcatgtgatttttgtttttaattctgtttatgtggtgtatcacatttattgacttgcatatgttaaaccatctctgtgcccctggtatgaaacccacttggtcatggtggattatctttttgatatgttgtcagattcagttagctagtattttgttaaagagtttagcatctatgtttatcaaggatatcggtctgtagttttcttttttggttatgtcctttcctggttttggtattagggtgatgctggcttcatagaatggattagggagggttccctctttctctatcttgtggaatagcatcaaaaggattggtatcaattcttctttgaatgtctggtcaaattctgctgtgaatccatctggtcctgggctttttgtcggtaagcctttaattaccatttccatctcactgcttgctattggtctgttcaggttatctaatttttcctgatttaagctaggagagttgtatttttctaggaatttatccatctcttctaggttttctagtttacgtgcacaaaggtgttcatagtactcttgaatgatcttttatatttcagtggtgtcagttgtagtatcccccattttgtttcttaatgaggttatttggattttctctcttctattcttggttaatcttactaatggtctattgattttatttatcttttaaaataaccagctttttgttttatttatcatttgtattttttcttttaattttatttagttcttctctgttcttggttatgtcctctcttctcctcggtttgggtttggtttgtccttgtttctctagttccttgaggtttgaccttagaaagtcactttgtgttctttcagtctttttgacataggtgttagggctatgaactttcctcttagcactgcctttgctgtatcccaaaggttttgataggttgtgtctttactgttgttcagttcaaagaattttttaacttccatcttgacttcatttttgacccaatactcattcaggagtaacttatttagtttctatgtatttgcatggttttgacggttccttctggagttgatttccaggtttattcaatgtggtctgagagagtacttgatataatttcaattttcttaaatttattgaggcttattttatggcctatcatatggtctattcttggagaaagttccatgcactgttgaatagaatgtgtattctgcagttgttggatgaaatgttctgtatatatttgttaagtccatttgctccaagtacagtttaaatccattgtttctttgttgtctttttgtctggatgacctgtctagtgctgtcagtggaatattgaagtccccactattattgtgttgctgtttctctcatttcttaggtctattagtaattgttttataaatttggaacctccagtgttaggcgcatatatgtttaggattgtgatattttcctgttgcacaaggctttttaccattatatagtgtccctgtttgtctcttttaactgctgttgcttcaaagtttgttttgtctgatacaagaattgctacccctgctggcttttggtgtccatttgcatgaaatgcctttttccacccctttactttaagtttatgtgagttcttatgtgttaggtgagtctcctgaaggcagcagatacttggttggtgagttcttatctattctgctgttctgtatcttttaagtggagcatttagggcatttacattcaatgtcagtatgagatgtgtggtactgttgcattcatcatgctgtttgctgcctgtgtaccttggttttttgtttttggtgtttggtttttaacttgtatttttgtttataagtcctatgtgatttaggctttaaagaggttctgttttaatgtttccaggatttgtttcaagatttagagctccttttagcagctcttgtagtgctggcttggcaggggccaattctctcagcatttgttcgtctgaaaatgactgtatctttccttcatatatgatgcttagcttgctggatagaaaattttggactaataattgttttgtttgaggaggctgaagataggggcccaatcttatctagcttgcagggtttctgatgagaaatctgctgctaatctgatagattttcctttataggttacccagtgcttttgcctcacagctcttagaattctttcttttgtcttaactttagataacctggtaacaatgtgcctaggtgatgatttctttgcgatgaatttcccaggtgttctttgtgcttcttatatttagatatctaggtctctagcaaggctggggaagttttcctcaattattccctcaaatatgttttcccaaacttttagatttctcttcttcctcaggaacaccaattattcttaggtttggtcgtttaacataatcccagacttcttggaacctttgttcatattttcttatttttttctttgtctttgttgaattgggttaattcaaagaccttgtcttcaagttctgcatttctttcttctacttgttcaattttattgctgagactttccagagcgttttgcatttctataagcttgtccaatgtttcctgaagttttgattttttttctttatgctacctatttccttaaatttttctcctttccctgcttgtatcatttcgttgtatcagatttccttgcgttgggcttcacctttctctagtgcctccctgattagcttaataactaacctcctgaattctttctcaggtaaatcagagatttttttcttggtttggatccattgctagtggactagtattacttttggggggtgttaaagagccttgctttgtcatattaccagagtttgttttctggttccttctcatttggaagctctgtcagagggaaggtccagtgctgaaggctgttgttcagattcttttgtcccttaatgtagtactctccctattttcctatggatgtggtttcctgtgagctgagctgaagtgattgttatctctcttctgggtctagccacacaaccagtctacctggctctgagctggtactgagggttgtctccacagagtcctgtgatgtgaaccatctatgggtctctcagccatggataccagcacagtatttggggtgtctcctgcatcctgcaggagcagtccacttccttctgtgggtcctctcgggattcctgtttcattcttgaagtctagatctattttttgacagtctaatcctaacaccatttactgaggaacactctttttttcattgttctgtaatgcctcctctgttgtaaattaagatcccataaatgccttggtatttgctagactttctttttcttctgttgttttaaaattttctctcccaacaagataaaatattgtgtaaatattatatgtttatactaagcatttttatcttgtactgaataatagtgagaatgcttcaaaatttcactgtttttgctattaagtatgatattaagtacgctattaagtactgtataggtttttggctgacttatttttgtcaggttaagaaaactgctctctatttctagtttattaagacagtttatcacaagtattagcctataaataatggtttttctgcacattcgaataatcatttgattcccacttttaaattattaatgctgtagattatattgatagatctgcctgatattaaactatccttgcattcttgatctaaatcttacttgaatgggatgtgttactgtattctctctctctctctctctctctctctctctctctctgtatctctcttcctctcttcatctctcttctgcaacatcttaaagcatattttggtaaatttgctttttatagttattgattttcagaaatatttctttgagaagctaaaaatgcaaaggttttatttcaccttgtttcaaatatagtaattatctaggaataagaattgtccattttctacctattgagaatcaaaacattcacagaacataaacctacttgtttcaaatatggtagttatctaggaataaggattgtccattttctacatattgagaaaaaaacattcaaagaacataagcctaaaacctctctttcttttgtttctaacctacgggaagcctgtcacttttctaaaagttatgatcaggctgagcttcactcccccttcctgggctctctggtagaatatgccctcccaagtcctccctagtgtgagtccgcccctgtccccacccatcccctctatccaccaccgcccccgctctcaggctgccctgcagttgtttcttaatgcagcagaaggctgcaacaaccacaaactacattgcccatgatcaacccatgcccatgtccttctgcaccccccagtcagactacccactcccacaacaaccaatatcagtgttcccatatttcatgcattatctatccttctctcaaataaagcagatctagcacattttaattatcctttgtgacagtctctagtattttccttgtttttttttttttgtctagaatttactttcatcttctgattcacaggaaatttgttccatattgtttttttacaagcaatatctagttgaattacccaccatgttttacttttttcctcaccattagttcattcacctaataaattcttattgcatgccttgtgttttcctgctattgtacatgcctggaaatataggagtcaaccaaatcgtctctgagctcatgtagttgacaatctagttagagaacagagatgataaacaagtaaatatatatcaaaaataattgccatggagaaaaattaagtagtataaggattattatttatctaggttgtcaggcaagagcttacagatgggtgacatttgaatgcatacttgaaagaagtctgggagaaaagtatcccaggtagagggaatagcatatactatttgggatcttcaaggaacatcaaagaggccagtttgttggagcaggatgagcaagaagaacgtagtggtaaatggaggcagagatagtgggtgagagtggggttgggaaaaaatcagataggactttcagaccactgtaaatacttggtcatttactctaagtgagataggataccatgacagtgtcctggaaaaaaaaaagggacatgttcttattttagtgagaccaatttgggtgttgggaataaggagattcaaaagcaaaagcaggtaggccattaagaaactgttataataatccagataaatgttggtgccttggttaagggagataaagatggagatggtaagaagtgatcgcattctggatgtaatttgaaggcatgtctgagaggattagttgatggagtgttacttatggggtatcagtgaaagaatagaggaaaggcctgagaatctggaaagatgaaggtgatatttactgaaatggcctacactcttgaatgaatagattaggaagtaaaattgaaagtctggttatgggttttataagtttgagacgcctataaaacattcaaagaaattattaaatagtgaactggatatatgagcctgtagttcaagaaagaggtctggattaaagttatgatttggacaacatcatcatatatgtggcattagtgtcatgattccaaatgagataatccagggaataactatagagaaaagaggagaggaggataatttctggtgatatttcaatgctaagtggttgggaaaatgaagagaacacagtgaagttgaccaggatgaagtacttactgaggtggaagaatcaatggagaagggtgttcaagatacaaaattaagacagtgtgtcagagaagtggggagtgatccattgtggcaagtgttattcattggttaaataagatgattaagaatttgccacaatgtggaagtcattggtgactagagcaaaagctattccattgatgtagtggagattaaagcctgatttcaataagtttaagaaattgggcaaggaggaattaaagaaaggagaataagacaatttcttcaagaagttttgatttagaggggagcagagaaatgggtcagtaacttcatgagcagtaactgaaataggagaaattatcctttttctaaaaggagataattttagtgcacacttaaggtgattcttatcttcctgcaaaaatagctcctttaggtatttttcaaaattttatacatgtatatttctattccaatcatttttggggtacaagtgatttttggttacaaggttgaattgtatggtggtagtgaagtctgagattttagttcatccatcacccaagtaatgtacattgcacccaatatacacctttttttatccctcagccacccctaccccctcctcagtctccagtgtccattatatcactctgtatgcctttgcatacccatagcttacctcccacttacaagcaagaacttcatggtatttggttttccattcctgagttacttcttttagaatagtggcctccagctccatccaagttgctgcaaaagacattatttccttcttttttatggctgagtagtattccatggtgtgtatatatcacattttatttatccactcattgtttgatgggcatttaagttgtttctacatctttgcaattgtgagctgtgctgtgataaacatacatgagcaggtatctttttgatataatgacttattttcctttaggtcgattcccagtagtgagattgctggattgaatggtagatctacttttagttctttgaggaatttccatattgttttccatggaggttgtactaattgacatcactaccagcagtgtataagtaatcctttttcactacctctacaccagcatttattgtttgtttttgggatttttttgtttttgtctttttataatggccattctggctaggaaaaggtggcatatcattatggttttaatttgcatttccctcctttaggtattatttaatgagagtcttttggtggtaaagtatcttagttttcatgtgtgctcacacacacatacacagagtctttagtgacaggctagttgggtatcaaattctgaattgatgtttttttctctaatacttttaaagtttatttgtgttctggcatctgttgttactaaataaaaatcttccaccagtccatttgagttcattagcaggtaatctgcctcttattttaagcacttttaaagatttttctgtatcttgatgccatatgatagatctaccttttattatactttactcagtaattactgtgggcttttaatctgcaaactcaatcaattattcgattttataaaattatcagtaataaccttttctataactgattatttgcagttgaattaaatcctctctttctggaattccaatcatatgtgtgttggagcttctcaatctgccctccaaggctcgtaactgctcttttaaatttttcagtactactctcaattttttttttaaaaaaacaacctaatattgcagtgtttggcacagaagaagttcaaagtacaactttgcactgccacgttgaccagctattctggcactggttattctttaaagttatttttaaggttaacgtaccttatcaggcagcaggtctcaaaacctagggaagcttaaaagcctaaaggcagcctggcaaaaatcaagctgattaaaatgctctttcccattttcttgtcctcctatgccctcatccctaaagaatagtgagagggccttccttaaaaagatatgtataaaatagcagaaagaaaaaggggatccagcaagcgtgagaagacatacttagataattcacagtaaatgttccaaataatattcagcctcactaattctcaaataaatgtaaaacaatggcagatcatttttatccattaaattagtgaaaataggaggaaaagaacattttgctgacaattgttaacagtgaaactgaaattctcttcttgtctagtttgaatctaaattaggacagtttgaaagcaattgggtgatatctatgaaaaatctcataaacattctacccttccatgtagcaacattgcttctgtgaatcaaccattaggcaaataaatggaaataacaaaccaaatttccccccacctcccaagagatgtttattgtaacattactgataatattgaaaaactagaagcgatctatatcagtgatccacccttgttttgactgtcactcaccgtaagaaaatattaggtatacaaagtaacccaacagacacacccatgcatcaaaaagttccatataaggaaaccgttcaatccattccatttatttaaacaagccaatgaacaaagctggctttgatccactaaattgatcctacaacctaagagtaggttatgactcagtttgaaaagcaccaatctgaatgtcctataaaagatatatgatggaatatgaattaaatttgatattcacaattttttacttttttttgtttgagggtagttggaggggtactatgtttcttcagccagcaaggaagataatgtttctagataactccatataatggagatttactgtaatgataccagatctgttctactatgcccagccattcttatgtatctgtctctcaatgcatcatgggtcctttatggattcttttgtgatgtcctcaagcttcctgtccactccctagcaacttgcccaaactgatagaaccggcctgaatcagtcaacatctgatttcaagcattttctcttggtcagcctttggtattaggactttattctcaatctaatcaattaatattagctgagctaggttgatttcatttgaatcaacaaagaattgctaaaagctgcatttcctagaaaatgtggcaatataattggcaggtacttgagagtctttaatgttaaatggaaaaaaaataaaaaataataagagacaactttttatacggagcatgttttcggttttctttagatattttgttagagacaaaaaaggaatccagaatttattttatactacattagtacttaacagatttctacataagcaagtattatgcatttgtaatcagaaaaaaatatcaaaattagctctgtggaaaatgatcatcttgcaagcaagcatcatgtacccctacttttgatttagctcatcttcttgatgtaaatatgaagtgtctgcgcttgaaattctgtttgaagtggaaatcttcatgtttgtcttacaaataccatctcagagtacattgctcagtataaaacttgttttggggggttgggtacaaaaacctgcaaagatatagtccaggctccttttcccaaagtccttcactttcctactcttagtataaccattattttgtaaaatttaataaggcccctaataacttggggtttgggaatttgatttgaggtaacatgcctcagagtatcacctattttttattaaaccaacaaatttctatctgacaaagatgtgcatttatgtgggccttaataattcccccaaataaaactattcgtaagttctaacagttccaaatacttttggtttcagcacactaataggatttatagctgtcttagataaggagcagtatcttctaaagctcatgaaaaagccatatcagaatgccatgtgttcaggtatatttccttttctttatggtatcaagaataaaatctcagcttatgttttcactcaagtgttgtgtgattactttttcccattactctttcgattgagcctgaaaaatgaggtgaaaaaatctttctctttcaaggatgaactagaaggatctaggctggctggtcaccaaaccactgactagttggccctttgtctttttataacccctcattgtctgggatccaacatcatagtgagtctcagacatgttccacaagtctagatagccctcatccatgtgttcagtggtccagcccatcagcatccaagccagcagggtgaggaggggaagtgtaggggatgctcattgccctgaaggatgcatatgccacttccattcaggtcctgcttgccagaacatagtcatgtgaccacagttagctgcaaggttggctgagaaatgcctttcactgggttctattactaactgaaaatgggaagagtgaaagttggggataactagtaaatattagttagtccaagtcatggattgtggtattaattccatgtgctaggaaggtcatttaaatgttttatgcagaaggatgccatgatgataattatgtttcaaagcatatttgtgtgtgagagagagagactgaaagagaaagtgagataaatggattggagagaatttgtctgagtgttaagaggccattctcaaacccaagtgggaaatggtggctagtaacagtagtgaggataaagggggatggaatggactcaaaagatacagaagagataacatcaaaagatgaaacaggggcagaggaggaagaaaagacatccagataactcctaggtttctgatttatactgcaaattctggggatcaggtgtttatggaccactgagtttagttttagaaacgtgatttagaggtatttgtcagataggtggtttctacacattcaaaataagatttcaaaacatattagccacaattcacaatcagcaaaattctcaaatctagtcattgtcaactaaactattaaaatgaattttcccctctaagtgtttctcatcttaaagggtttgtatgtattacatgtcacagtatggtttattgcatataaacatgggaaagcaagccaggcagaaggagtcttgtaaccagctaaaggcccagctaattcttgaagcagtcataaatcatgaacggtcttcttgtgttaatagtgtggacaggactgttggtcacacacaggaaaatgagtcacacagtcttgtgtgtacagcaactcactccacactcaatgatgggaatggtcatgattgttctaactgtgtgagcagctacaagaattatggcaaagctccagagctagaaagctggttttttttttatgtcacccgagtatgtaattcactaaatgtttagtattttataccttttagttgacttgtgagccctttctaaaggagatctatttccctctactagaaggtaatcagaaaaaccctaaactacgttttctaaatgctgtgttcttctgcccaattgaccaaaatatacttagttgattaggactttgaagggatgagatgaggggactaaattaagatgcaggaatttcagttttctaggggttttctgtaaactactttatactgctgacaaatggttaaatgtttccaatgaaactaagtatgctaggatttctaatgagcaatgaaattttagaattcatttactcattaatttcttcatttacaagatgtacaatgtgctatcttctgggcatttggggtactttaatgaggtagcagtgagtaccacaaatggtcacttctgcctttgttcttatactccttagagaagggaaaggaccagattcagataccctatcactgctttctacccatccagatcagagcctttgctgagttctaacgcttagccctcttctcagctgatttggctgcctccattgtaataggcctcatgagactccagcctaggcctggccttcagttcagcaggcagagcccagagatgtactgggcaaaggtcaggggatttattatatgagacaatggtctgatgtgatttaatttactcctctggtaccagatatgtgtgtgtgtgcatgagagagagagattgagaatgactgatttgggagggattttgtgaaggtttatatatcaaagcagaaagaccaagaatttagagattaatacatgccaagtggtaaccaagaaacttctgtgggatcccacctccaacccctccctctctgtcagattttaaccaaatcagtgtgatgtgatctgcttgcatatatgagtgaaagaaaaaggaaatttaaaaagttcttgatataaagcctggaggaaacaatacgaaaatccagcctctatttcagcaatatctgccggactattggttagtattcccttactgttacttattgtttgattaaaaggctgatagtcagggttttttttttcttacttttgcattttttagatataaatctttaatatatggctgtggccagatgttttcctttctcctcccacttcgttcttccctcttctgggttaatttctcattgttctctcttccccttacttctctgcccttttcctttctactctaagcgaaacttctttttttctgtgctggagtttataaagtattcttttaggcaaagaaagcctttggctgccttcctccttgtctggtcaccatcaagatataattttggttttcaaaggttgttctctgaaggaaggactagttttctgagcatttagagagcagatacattttgagaaagtcaacagagatagtaatttgcactcaggaaatacttaagggttttaattctgttccatgtgttacatttcaacagtttacattaagaaaagtattgtaaagagaagtgataccacaattgcatgtttattttgcatctttagtctgagagatggtcagtactttgaaggaaagagaaatagggctttgtctccttctgcttcttgctatacctcttttcagattaactctgatgctttgggtttcttactgcatgcctgattaaaacccatcccataatgcctgatgtgatgggaaccaccacttattctatctcaatggaaagtattcacatgagctttcaacagaaggacattctcccacctcttccaaacacctctttgaaaaccgtgtccatgggcctttattcatgtcttcaacaatttgtttaaaactggttgtgctaggtagtgggcaatataaagatgagccacaggagagagatgacaatatcactgattccttatagtgctgtaataagggtttattaaggctgtgatagaagtagagaggagaggcacctgacttcacttgggagtggggttgttgctaaggtgtttctaagttgaaatgtccttgagctgaggtttaggggaatgagtagcaaagatggattaagtgagaagagtataggaggcagcagggccagaggtgtgaatagcccagaaccttctgagaagattcctttgtggacggaagaaaggggaggtttgtggaaatggtggaagataaggtaggaagaggccacatcagatcacacatggctggatgtacctctctaaaagtactggggggtttgaaacagaggctataaattggcagtttaagaaaatcactgtggtgtcagtgtgaagaatacatttttgcaagattctaacgaggattattttcagaaatttaggcccaatttagtccagatgtcagggctagtttggagtaaatttctttctttaattactccagggctcttgtattgcttcaaagaaagtagaaagtggaactcaccctcattcagggagggtgggcaagcgaccagccagctggggaaggccaaagagccaggtcaccttgtgcccgcacttgttatgatttgtttgtattgtctgcctgatgatcaatgatattagctatgacagcacgtatgagcctggggtaagtgtgtcttcttgctacttgaagtgcttcttgaaaatagtggcaggctgaagacaacaaggaatactgaaaaagcccattggactggggacaggagacctggtgctgctcccagcttggccggcaccagctccgggggcttagacacattacttcacctctctgggcttaacttaccccatttgtaaaatgcaacctttagactaacactgttctcggggccatgttcagcctctggcttctgtcattgtgatcctgcctccccaaggttcccctgggccccatcactactaaccctaggcttctagacattctgattcatagagaaataggaaagcccatttatcttaagttaatgtcagccagaagtacagttgtgtcttaaggaatctaatctagtgaacatggaaaataattttctaaggaaaaaaattgtgattggtgttctgtcctgaactgatggcaaaagggaagcagaaccacttcacacatctcaatctctctgttttttcctttttatcctcttgaatttttctgcctgtttgtctttcaaaagtagagaggagtttgaatggggatgctgaggagactgagggtagccaccgatgggggaagctggactgtgggaagccgagttctgccacctgacaaaggggcacgtgtttagtgtttatttggcatagcagctgttcaggtggagcccaggcagaattttgatgtcgttgggaccttccatacctttctgaaattctcttgcaccaacacccggcaccctcaggttatgttctgctgcccaaagcctgaggctcaacttctagccctctcttttctcttttaccggaactaacttctaaaaatccagaaatgacaagtagatggtggtctggatgttcctgaggtggaaagagaacctctagtgcctctggctgacattatatccactgacagatcccctcccgcacgcatacatgtcacatgtttctgctcatttatcaaatacagcccatgctttggtgattgagagcagagtggggattataagttgatgcagtaggcctgtgtcttgcccttagaagtttacaaacagcaacacaggcaccaagagctcatctgttacacccacagggatttatcatcttgtgacttggatattgtggaatgttttatagtaaaggttaaaaaaaaacaatgtaggcacagaggagttaacagctaagttgcggtggggagtctggaaggcttcatggacgtggtgatatttgaacgtgactttgaagggtaggtagagtcctgatttgtctaacagtagccttgaaagtaaaggaaacttgaccatgaagaaggctgttgaaagtctggagaaaagagaaggtaggagactaagactctaggagaaggtactacgttccagggagaatgcagaggtagaatcctccctcatggtgacaagttaaatgtgagaagggatggagtaaccaactgggtgaaccctgatctcattaagcaaaataagaaatagaagaaatgaatctgcatgctcataatgtagggatcagaagcaggtaggaaatgctgactttattttagacagaggttattttaggtacctgtggacatccaggtgtattatttccctatgtctgaagcacatgtcctttggttctttagcattttgatgatgatgctccatgtaaactgccccctaggattttctataagttttcttcctcatttgagagtaaagttttaactggtaacatgatcacaagtggttgaaaagttaaaatgttattcatatagctttccaatgaggggagcatgaatggtttggtactgttttacaagatgtgaaaactgatttcacttaagtagactgtaacataaagtttatgtgtctgtccctttggcttcctggtaggtggacagtctctctgaatcaatagtggctcaggcttctgatttcaaacctctttggccagccaactggtttaggagaaacatggccaggtcattgaattataatttcctgagttatgttgtggtggtcccgtaggacagtaaacataagcctcctgggaactgaacttttaattcaggaggactgaaaacaagctcttctgagccaagatttgcaaggacatgttacaaagatagactggccttcctgcttccacaccattttttcctccataaatacatgctccttttccgtatttttcttctaccctagtctgttgtagattttgaccttggctgttactttcctaccaacacattgcctatttttaagtttcctggtttgacctgatgttaagatggaaagcaaagctagcaaactgatggagatagggccttccagcctttctaactttccctgggatcatcttatgttgatttacatgttcaaaaaatttttaaaaataaataaattgtatcagttgatccagaagtgattagactctaggggcctgatttatcttagccaaacttaagagatgagccaatacaccaaaatgccaatatatttgtttgttctctatggcactgtcaagcaatttcatttcatctgattactgtgttcattttcctgaaagatagtgaacccagaaaacaagaatcagaaggtcatttgacaactgtggagttggaatagagggaactgaatgaccctctattgggtcatgagggagagcatcatcaagctttgagaaattattgcacctgtctctgtgttgggacatttttttggtcccaggtagttggaagagacaaagctgtaaattatttactagtttttcaacatttccttatcacttatcgttaactgatggaactaagttttctctaaagtcccttatgaataaaattgctagacattgcaaaaatgcccctctcaatattgacatgcttcagtggtgattatcttcctgattaatgtttacagtcaatctcaagctctataatggactcttaaaggctgtagtagttttctattgcttccataacatattaccacaaacttagtggcttaaacaatacccatttattgtcccacagttccatatgtgagaagtctgggcacaccatggcccaactgggctcttgcttagagtttgcaaggcagaaatcagtgttgttagggcctctagggatgaattttcctccaagctcattccagttgttttcatgaactgagttccttgtcattgttggaccatgttccccatttccttgctggctgtcagctgggagccagtttttgctcctagaggctatctgcattgcatctcatggtttctgtgtgcccccttccagcaacaagattctatgtacccccttccagcaacaatattctatgtaccctcttccagcaacagaagatcaagtccttttcaagtttctagtctctctgacttccccttctgccatatctcattctgcttttacaggctcaggtgattacatcggtttgtgcagataatccaagataatctccctgttttaaagccagtgggttagccatcttaattacatctgcaaaattccttcacagcagtacctagattagtgtttgaataacccaggatggtaatcttgcgggggatcttttagcattccatctacccagtctcatcagcaacactttgaaatattgtcgttgagtgatcatttctgtggccggctgatttcatctatacaagtgtattctttttatttgccattttataggataatattttctgatcttaattccatatttcagtattaaaattacttgacatagatccataaatcatcatctgttgcaaaaaagcacattaattgattggttgaatggggagattgagatatttcttttctcttcttctgctcaggtgggggcaacttttgggggcagatgagttctgttgccacaaaagttatatagcacatttggtttgcactgaatcagcgattctcaatcctggccatgctttagaattatacaagaaaaatcttcaagtatcaatactcagtccctatcctactgatccaattcatctatgataaagccagagcattgatttttaagttctgcaagtgattctaatatacagccaaggctaagaactactgatatgttccaaacactctattttggagataaagaagttgaggctgaggatgagaacttagtcacataaagttccataactagtaacagacagaagttctgtcctacaaaaaaaaaaaaatttgatgctttaattgtatgtagagttcagtgctcagtaattatgtacaaagtgagtgttgagacgatctggaacaccctacttcttgctttagtaggaagactatttctttctactactttaaaaaattatcagatcttgcaaaataactgtatgaaggtctcttctcagcagctttggcctgccttgtgagtaataataaacacagatctattctacactaactagggagctggccgcttggacttctactacctctctgtgttccagagcttcatggtacaatgcagtagccactagccacatgtagctattaaacacttgaaatggaactagtttcaactgagatgtatgtgagtgtaaaaggcatactagaatcaaagatccagtatgagaaaaaaggtgcaaaatatctcattaatacttacattgattacatgatgaaataatatttgaatatattgagttaaataagatacattattaaaattaatatatcaatttttaacttttttaatgcagttgctagagaatttacaactatgtatgtggttggcatttgtggctcacattatatttctgttagcacttttctagggagtattttctattaaagctattaacaatgaatggtccaagtccaagctattacacctcctttgatcctgaagagtgaaggggtacactgtaaacttcctggagatgagacatgatattgatctgccctgtgtttgccatctatctggcagccagtcagtctggccaaatagacttctatttttacatagaagcttaaaggaggcaggataatgccccatgtcatggagagagcacactgcatagctcttgagtaatgtacccaaaagtagaccaggtgctattggaggttctaaggcatagcgataaatattacatcccttgagcaatgtaatacagcccttgaagaaactgccatgtcagcacttatgaattatcactgtctttgacaggccctatgcactgaaaatattatggtgtctacctctctttataattcacatccaaatattactctgtctttttcttgctccctgtagtttgttctgattcactgctaccctgattgtgtgtttagtttgcctagttcacaattgaagaagcatgggaaagtaaaggcaggccttggaaagatcaagcacagttcgaaaccctacccagaattattctgtctgtgtgagcttgggagatttacttaacctctctgagctcctctaaacttccattttctcatttgtgaaatgagcctttctcttgcaaggtctgtctgagggttgaatgaaataagaaggtacctggcacacttattttttgggtagatgttgtagtgaacatctactctgtggcaagcctatggctaattgttaggatgtaatcgtgagtgagacacagctactgcttccagctaagagaagagaaagacaaggagcctggtaacgtcgggacatgaatagccgtcaatgaaaggcagctattattacactgcacagtgcaggatttggcttataacaaaattttagaagggtgttcaggtgagggaattgagacccatagtgattaaatgactacctgagtcaccagctcggacaatgctgggctgatgtcaggttacgggattgctgactcctcctctagtaatgcctttcctgggagatcacattgcctcactcttggtttcccaacttgtttaccttcaaagaataactttaccatgttggactcgataaaaggaaagaggggtttcctccaatttttgctccatttgttattagggcatgctagtaactaactgtctttgaaaacctacgcttctgttaactccaaagaaggcaggaatacatgcacttctttaagatataaaaagtatttagtatactataaattattatagtaatcattgttagattatatctcaccaagataatgaatgtttttgtttgaagacttcactgtatgagaaattgtctcctataccttatttatctccttttagattaggtaaaacaaaattttcaaatttgagtctgaagaaaattccaacatctttaaatttgtttaaggaacattttccatgatctatatgatctatcatagtaatttaaaaaatcagattttagaatgagccacgtgtagaaagagaaaaaaagtagaaagtcaataagaggtttcatttttcaaattttgttttggaaaaaactacttggtagggacaatggtgtaaagtaagatataagaaggaatatactgttcaaataagcggccatgcaattgattttctctttcatgtaacaatcacatctgcattgtgaatccgttagtgcaccaagtgaatcaagcttagtgagttgacaaacatccacagggatagttgcggggaggcattataaagtgcaatgtggtcctagtgaaacagaatgcttcgttctttgagaaagttccactctgaatagaataacggtgcataccaatatcggagtatggccaagcatttggctactgacatgccccttcttctttcactcctccataaaggaagagacagagactcaggttcttgtaactcagttgccttttttgagttctcccaagaaaagttctaacttcaagccaagcgtcttgtcactgggatttctgtatctaatttttagttctagaaatccatgatttcacaaaacaaattatccaaacctaacgacaaccacatagaactttcttaaagtagacgagggaggaattagcccctaaagtatttcctgcacaattggaactcactatagaagatgtacaattgcctgtacacccaagcacaaataggctgtattattgccttatcctaggagatatacactttacattatgatggtccttccctttcctggaccttcatatgatgtaagtgcttgatttaggaatagggtcttacatattgtggctggcgaagagcacatttgctgattgctctaccacatgcctagatgtcctcttcatgatatataaatgagggtccctactctcaatataccccataggaacataataaaacataaatagtctatttgttactactaccaagaagacttcagtaagtgtaataactaacccttttggatacatgcagagggaatgccaaatgctttaaataaattatctcatctaatcctgatttttttattaaaaagggaaaatcttatcatatgaatattagagatgagtaaactgaggtttggtagagctgggatttgaacctagccctctgtgactccaaagcacattcacttaaccccaagcccaccctctctgtaaatgaagattaatgatagcatctgtggtagaagctaatgtctcctgacctgggaaaatatctttcaatgattattaactaaatgtgatcagctgccagtggatcagatgtcatcaaataaaatcgagtgtccagggtttactcaacagtactgtctcttacattttttatcaatgttagtagattgcttaatctttgtacctgttacctcacatgaagcctagatagcatcagtcccttccccagccagtttgtgctgggttcagcttctggcttgtgaatccagtcagtgaattaatgttggtagcttaaaaacagccctgagagaggtatttacatcacagaaattggcaaatgatacaaatcatgaccctttttttaaattccagggagacaggtgttaaacatttaccagtacaccactgtctatgattcaaatcgggacataataattgtatttctgaaggtaaacaaatgcacactgagtacccttggaaaaaagcaaccttccacagatacaatcacacctaagtcacctaagtctttagtgaattttttgtccccatcattctgcatttgggaggaccttttacaacataaccataatgattttatatgtcatttgaaattttaaaaaattactttatttgttcatttttgttatgaaagcaaatatgcccatagtaagcatttaatgtttttgaatgtaagtgcagacatataaaccataaaatgtatatacgaatgctaccagtagaaataaaatgcaagccacatatgtaatttaaaattttcaactatagtcatgcaccacgtaatgacttttcaatgatggactggtcccataaaattataaaatcatgtttttatgacatcttttctatgtttagatatgtctagatacataaatacttaatattgtggtaaaattgcttatactattcaatagagcagtaacctgctgcacaggtctgtagcccagagcaataggctatcccatatagcctaggtgtgtagtaggctataccatctaggtttgtgtaaatacactctgtggtgttcacagaaccatggaattgcctaatgatgcatttttcagaatgtattcctgtcattaagtgatgcatgactgtaatcacatttaaaaaataagaaatatttgttttaataatggattttatttaattcagcagttaaaaatatgatttcaacttgtagtcaacgtgaacattatcaagatattttgcatcttttcttcttgtactaagctttcaattctgtgtatattttatacttatagcacatatgaatttagatgctaaattttaatcataaatacttgatctgcatttacatttcataaaatgtaaagcttaaaaagtgggttcatatatccaatctgttatagacttacatatttaattaaattaaatttaaattgtcattgaattcctcaattgcattagccacattttaagtgctcaatagccacatgtgacttattgtaacataattggtcattgcaggtacataccatatatccttattttataaaattggaaacctaggctggatgtggtggcttatggctataatcccagcactttgggaggccgagacggaaggatcaggtgaggccaggaattagagaccagcctgggcaacacaccaagaccttgtgtataaaataaacaaataaataaaaatagctaggtgtgttggcacatgcctatggtacaagctatttgggaggctgacgaaggaggatcccttgagccaaagagttggagactgcagtgagctatgattatgccactgcactcccaacctgggtggcagagtgagacccatgtctcttcaaaaagtaaaaatacaaataatataacaaataaataaataaaattggaggcctactatatatacaactcccaaaagtcttttcccccctcacacgttacacatttaaaattcccatcctgcattccctgctggatctccaagaggagagaaatctcagcaaaagtagttatatcaaaactgtctgtgagctttttcttcctcactcataggaaggaaataaattcacataaggcattttggatctgaccattttccaaattatcatcaccataaaaagttggtaacaacatgaactctgaaagcaagctgtttcaatgcatgcctggtgctaatgaaaaccagcagttttaaatgcccttttgggttagcttcttcctttttctgtgctgtattattagaaaagcttcaccaaggagatcaactagatataatttcacaatatttcttagtaatcaatgttggcatttactcttcccatatattaatttattaacatcatgcttctaaggatgctttaatcacttttttaaaaaaaatacttgatacaaattagagggtgttagttattttaggtggtgatttgttttgtttctgcaaaattacaaaccagatatgagcatattattccctgtgtggcttaataaactgttttttcttttttgagacagagtctcgctctgttgccaggctggagtgcaagggcataatctcggctcactgcaacctccgcctcctgggttcaagcgattctcctgcctcagtctcccgatcagctgggactacaggtgtgcgccaccacacccagctaatttttgtatttttggtagagacggggtttcaccatgttggccaggatggtctcaatctcttgaccttgtgatccacctgcctcggcctcccaaaatgctgggattacaggtgtaagccaccacgcctggccaatacacttttaatataatttttgataaaggtgttatggagacttgtcaccaaatagtctagtcttcacattaaattcacatgatactcctcatctctatttagctctctctcacctccagtaatgacctcccttgtctctcagtctttggtctcttaccttcagcttcccactagccgtttctcacatttccaaaagtcttgtaattgccttaaaacaccaagtatccaaagcagtcctatgaccttctcctcctgctaaccaactcagatccccaaatcctgatttctttcactagcactatctctcatccacacatactcagttatttgtgatagacatgtctctatcatctctcatatccaatcatcaccaaatcttatcaatacttctcagtgatattaagttaagaagtcatgaagggcggctgtaccctaaggaaaacccacttttgcacaaatctgagtttctgatcaatctgagttcagaatgctgttttaatctggtcctacctcgccaatctaattttaggcccttttattcgtgaatttgaaccttgttctctattcaccagcttcctcagaatattgtccaaaacatactcagaattcatactcatatccagaacatttgctctgagcttttaccatacaagttcaccacagtttctctcccttttccatatccaccaaagccttatctgtcatttagttttaattttaagcccttcagtttgatagctgatttttccctagtctgaccttctattttcgggtatgctccttcttttcacagtttcatgtgtttgtactgccttattcttgaagaaccattattttgattgcttttgcattaatctccatagtgccttgctcagtgttagcaggaactagtagtttaacaaatacttgctaattctaaattaaagagcatgaaacatattgttttctttgcctggagttggttatagcatgctggaaaaagtattatatctaaccttcatcttttctcatgtgtttatgaactgttttatagccaaagaataagttagtatatcatgggcctaattatgtaatttggaggcctcctctgctgggcagtctacagatttaaaattcatgccagctgcattacgctggttttgaacttgctttttcttgagaaagatggggagcagacaaaatgcctcaggctttgagggtagaaatggtgtgagttccattatgcaagaatagaaccccattttttaatccctcctgctgaaaatcttgccatgaggctatagccaaagaatgtgtaaatatcaaaagaaatttagagagggattttccctaggaaaatattgcaagcttaaaaaacccagtgggctaaggtccaatttagtagattcctccgaacaatgccatcctctacttagattgttacagaacttcttatgacagcatttgagtagactcctgtacctctgggttaaaaggtacatgtaataagtttaggtacctgggcaaaaagggcttggcagaggggaatagagggactttcttattctcacatctagtatatcattacattgtaatgttagataacattaaagttccaaacttcatgtgtccgcactctgacgtttcctagggacattttgtctcagctagaatctaatagagaaggattccctcatctagaagcttccatatggggctctgtgaagatgatgtggacagtgtacaatccaattgaatgtcacgtctcgtggcctggctcatgtgagggcactagagagagttctccagaggagtgcagatggggctacttttggaatcattcccactgagccaacatcagtggaagagaaggggaggagttagattctaataaagcccttatcttctgctgaatccatccacatttttttatcctcctcctggcccctgcacttagttagagtcgggtccctatgcagtgttccaggcggcagtgaactgcattcacctcctgtttgggagcatggcaattttaaatacttttttctgctgtaagagtatgcaaacagatttctggttaattttgtgttgaggattcttgtttgttttttgttttgatagagcacattctatggacatatgttcagcttgtaaaggaagtgttatagttccttttttttttttttttttttttttggagatggagtcttgctctgtcaccaggctggagtgcagtggcgcgatctcgactcacttcaacctccacctccctggttcaagcgattctcctgcctcagcctcccgagtagctgggattacaggcatgcgctgccatgcccagctaatttttgtatttttagtagagacggggtttcaccatgttggccaggatggtctcaatctcctgacctcacgatctgcctgcctcggccccccaaagtgctgggattacaggcatgagccaccacgccccacctagttctttatttggaagaagtgaagttcatttgcaggcagctgctttcaaaagtttggggattggaggaaggtcatcttctattcaactgaagcaaatgccacttgtttgtggcatctgccaggcatccttgagatgtctgaagaggtgacttccaaaccagaggatgcagccttccgagaaatgcaaacctgttcacattcttgctcagatgggaagcagaaaaggctgcgtgggaattggggatttactgttatactctggcattggaatagcaggtgctactggaaacttctttacctgacactaagtgtcttgggagataacaagtaaaattaacacagcatccagttcttcagtgctttctccacttaaaaagaatcaggctgggcacggtggctcatacctgtaatcccagcactttggaaggccaaggcgggtgggtcacttgaggtcaggagtttgagacaagcctggccaacatggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaatacaaaaattagctgggcatggtggtgcacacctatagtcccagctacttggaaggctcaagcaggagaatcgcttaaacctgggaggcggaagttgcagtgagctgagatcgtgccactgcactccaggctgggcaacagagtgaaacaaaaaaagaaaagagacagaatcaaatgcaaagtaaatatttagttaccaacaggatggcatttttagcctataactttttttcagccttttaatatatttctgctggaggtttccagctttgattacatagcctgttcacctaggagtaaaggacattgggagggagagatgctcagtggttctcatttgcaaagtagacgaggatgatgaaaggccatcagctcaaggccttccaggttaggaattaaaaacatgaatgttgtaaaaaccacaactcatatttatttgaaatctcacaaagtgtgagatttatttgaaatctcacaaagtgtgagatttatttgaaatctcacaaagtgtgagatttatttgaaatctcacaatgtgtgagatttatttgaaatctcacaaagtgtgagatttatttgaaatctcacaaagtgtgagatttatttgaaatctcacaaagtgtgagatttatttgaaatctcacaaagtgtgagatttatttgaaatctcacaatgtgtgagatttatttgaaatctcacaatgtgtgagatttatttgaaatctcacaaagtgtgttcatctgcatgtttctcacgtgaaatctcacaaagtgtgttcatctgcatgtttacactcaatcctatgaacgactccatgaagtagtgtatgaaggagagttcctcatgcatgtggatttgcacatggggattcagatacaagaagacaatttagtttacatagagatgtgcttttttaaagaaatttttaagaatacaaaattatatggaacaaaaaagataggtcctctgctgtctagaaattaaagtacgtcaagaattttatccctatgtagaattacacagccattgccgggggccacatctgtaggcccatggaaaaaaacatctttgctcattatttcagcctgattagggataccatgaagggctattccattaggtcaggtttgcacagtaataaaaatgaagccagtagaggatctcgtggagctcctggtatgatgataagtctctgagtaacttgtaaatagtgcaattttatggaaatgttgcagctaagctttaaagtagttggcattagttgtcagacacagcaacagctctacaaaaggcaatacgctgagttcattttcaaccagcccaaacttgcctcagaagatccgggatgtggacaccctggtatattttttctagaaaagcttatttccttcctccagataaaggtgtatggtcactgaggtgttgtgctgacagaagtgttgatctactctctccgttagactgaagggctccaggtgtggccacactgggcttctaaatggctagcaaagccacagacgcatccctcttggtgtctgaggtgttcacattcctgggtctttcagatctgtattcctcatgaaaataaaacctctctacgacacactgtgtccttgtgggtttttagttttactagggagtttttgtttccttttgcttccctccttctttctgcttcccttctagttaaacctctttaggatggctcattagcaactcgttttgagtggtttgagctcttttgttcactgggaaacagatttatgaaatgttactattaccatgattgttatgtttttccttttatggcctgtccagctcaaggccccatgctttctgatactgctgataaggttttctatttccagatcaaattaaagcaaaccttactggccctgttactgaagctgtgcatgggggtcgtttgctgtgaggtgtttctatggctttgagccagggtatgaacatctctagtgttcatgttatttcctgagactagcactcacgggaagtagaatttattacaacctgctgtttgagttcatgaaaagtaggacaatatgagactctggggcagtgaaagacttaccaggattccttctggaactgactcgtcagctcattcatgtcttacccagtctttaaacagtatttcatgataatggtctgcttttaattgctgggctttaccttaccctttttgtgattgcaggtcctacaggtatggatctctggcagctgctgttgaccttggcactggcaggatcaagtgatgctttttctggaagtgagggtgagttctgcttttccatttccaccctcagtgttttgaaacaacactgaactgtattcgctacatccaagttttttggatgattttattaaaagatgcaagttttacatagcagcaaaaaggaaacttgacttagctttaaaatcagaaactagtaggacttttctgtggatgtttaggaggaatgcagtagtcagtcaactttggcatctgatgttttcatatcaaaaattaatactacaaatcatgctgaggacatttatgttgaagacaagccaggtctcttgttctcaggctttgggagagatattgaaattacactgaagggttattagcttactgttcactcagctcatctgtgactaaggatatctaatctatttccagagctcagaattcaggcttgttaatcatattctcagagaaaagaaattgcaggtttcaaatgaatttcacttctcactctctgggtgattaccatttggctaagttgaggaaagagacacctgaaatagttgaatgatatacccagaaattatgagcttccttccccatctctataattctccctcccttttttatatccctctccttgtagagaagtctcaatatgtttaaactatgtttcatagcagacctaactaaaacaaggaagagtaatagaagggaaagggaagaggaacttttctgtcagaaagaaaactgtgctctctaacgggtgggagacttttttttttttaatgagtacttgatgtttttccttgcctgggcttctacagaagaaagaaagaatatatttctcccatgctatgacactgaatttagttgttgctttaagagtgtcagactccccttctcaccattcagctcatgttggaaaacacagtttaacagcagacttagcgccttaagatgtcctccctgaccttctagccaaaaataaatccgtagtagtgagctgctgagggtgaccacagtcacttagaaaatgagaagagtaaaatatgttattttatctcttaaagcaatttaaaaatatttatagaaaagagtcataattgttggaaatattttttggtctctctggcgttataatgtcaacattatgcaagtcaaacatggagagaattgcaggctccatttcagcagcttttcccatggctggttttagaccttggttctgagccaaagaattgcagctgagatcctctgctgttccaaagtcatggtggcttaatctctcgtttcttcattaaggtgactttcactccactgggcaagatttgaggaatttaaaaaacttgtgaaatgaaaagtatggcataggaaatctttaaagaaaattaaaaatgcatccccagctgagagattagagctcaaattacattttagaactagaaagtctgcaaggagcatctgtttcagctgcttcgacattttactaaaactttgagttcctgagtgaagagaaaacatcactagttgcttttaatgtttgctttttgtttttctttttaatagttttgtttgattcatttatttgttcagggagagcagaatataagcaaatgcaatagtttatactaaacacaaatcacatatcctaccagtacttacgcataagaagtaatttaacaaagaagaacatttttgtctcttttttttttgtcttattgaactaaccaatatttctttttcctttggaatatgtgcatattccagaatcctttcttaaaatggtctaaggattaaggatggggcatgatgtttatgtaagaaggcatatgtaagcacgttccagtgtgtgtgtgcatgcttggctctgtgtgtgtgtgtgtgtgtgtgtgtgtgtgtgtgtgtgtgtgtgtgttctagttctggccacttatctaatgaatgggttcatgggttcagccaaagttactgcataacatgacatgggtcagtctcagataatatttatggaccatgtgtttgtttttctgccaggtctggattgtagccaaatcattttatttttattgtgtctcctattgaataaggcagactaaaaatatagattaaatttttaaaaagaaaagatactactattgaattcagtttgttcagtgaaagatgtggcattgatgggtaagtgatcttggaagcatcacctggagaaaagtcacccaggagctggtagaagatgacagacctgtatgcgtagggaagggtagcacttgagcagggattttcttgcttgggcagatgagcaattagaaatatactggccctgaaaggatttttttttattaaatctaattgccctgtgggaaatttaatgagaactaaatttgaacagtgccgttattgtgttagctaaagtgttgtaatagatgttttctgtctctcatccttaatatgaagttctcatccttaatatgaagctctatatctgctcctcaaagccagttacatagtctagaggagaattttttattccaaaatcaggaatgatccacaatgccttgttttcaaagggcttcacatggttgacctatcaactgattgtatcaaaattgctgctgctggaataatgttgctaatgagaaatgtgcataaagatctaatggatataagtattcttccaaggagtgcctgttataaattaggtcgtatatctctactatttcaatcagtctacccttgaatataccctttgacctcagtaacctaaggtggaagtaagcaagcccctgccttgtagttcagtctagctgggacatgaggaatgtcttgaaattaatgagagcctgtatacctttaaagtctagattgtgtgatgaagagaaatggtcaagatgccctgaaaaagaatagatcaaggtggactagaatagttaattcaacaaattcagtgtactgataattcttaagagcttcctattttcaaagcctgcacctatggctatgaggaatacattgattcttccctcaaggaacttttcatgggttaataaatcaggcatgtacaccaagaattacaatatcaggcattgtatattaactatcaaaatggcttgaatcacactttatagaagtgatgatgacgtgagggatacctcagctgtggtgaattacagcttcatgaaggaggttgacattgtttctctagagactagaatgtcaggtttaagattttaaaaggctgagaagaacagaaggctattacaggaataacttatgtgataaagcaacaacataaacagaagtgtacagatgtagatatgagatgtctatggacaacaattcattcacttactgtgctagtcaatggatggttctattttatgcatttaacattcaacaagcatttcttgagcacttacttcgtggaaggcataggattaatttggccagggtgtgtggtacataggtgctatatttgtaattattccctttggaagcaaacttaggtcagtaggtttgagtcaaattatagaaggcccagagatagcaaaggcattatggaaaaggcaagacttgctgggcccttgaaaaatcggtagcatttggagaggaagaaaagaaagaggaagtgtatgccatatccagccagtaatagtcctcaatattggaggccagacaaaagcgctacctgcatgatggaatagtgtgtgtgtgtgcatatgtgtgatattcatatgtaacatatatagtatctacatgtaatattgatatataatatttacatacaacatatttatatttgtatgtgtgtaatacatacactatatgtacacatatacatatacatgtatatatatgtacactatatgtatatagtatatgtatgtgcacaccagtgaggtgtggcttgcaggcaaagcacataattgacatcactcaaattctgcaaaaggtgttatatcattctgtaccattcaaagtaagagacttaggaatgagatgccacatcctaagggaaccaagagccccaaaataattttttctgtatattttgaacatttttcataaacctatgcacactgacaaaacacttacttgaaaggaaagacacccctgttctcattgctatcagacagcaacaatttattttttaaaataaactctattccaccacagttgaggttccacagagctctgagaggatgtcaagacatgtcagatatatttcacacaagtattagagtcatggtttcagttagtaaacagtaatgaatgcatctgttaaatgtgttcaagaatgaacacttcaaggctttccattcacagtgaaggtggggaaaaaagccacagagcttttgattgctgctgtcttcaccataatccagaggcaagaagaaatcttatggtgtgttctagtgcaatggcctgcgtccatgtacatcagcaatcctctgtccccttgtcctcctgatattgcagaatttatttgatgttggagttcagcaggtcacagcaagctggattaatctagatggtgccaatgtagataatgacacataaaaagtctttcaagaagcttttattaagtcattttacagattcaaggaggaatttcatgtatttatttatttattcattcaattttgcatgcatgcatttattcatttttttgttttagagataggaacttgctatgttgtgcaggccccaaacagttctactagcttcaaacaatccttcttcagcctgcagagtagttggcattataggtatgagccactgtgcccagcccaaggaagaattttgaatgtatattcctgcttttaaggagctcacagtctttagaagagaaaacagagaaataaacataatttaattgtgatcctcttagattattaaagggttttaatctaggtaataatactgttagatttttactttgtcagtaatactagtaataggataaaagtgaatttgaaagggatgaattagaggaggaagttgatgacaataggtcaggagagagataatctaagtgtgacagggatgataaaaaatagatggatcacaaacacggggatgttaagaagacagaattaccagtactcagagtctaattaacctgtggatttttgactcggggaactatcagtgccttcttttccatccatttctaagtttctgcatttttaattaatgtgatcatcagcaatgactcacgtttaatgcagtgaagtcctggtgcacagttcagcctattagcactaaagtggcacttgcacagaacaactctgtaggggaggaaacatgctgaggctggatgacagcagagtgtctaagctacgcttcttttgtactatttctctgaactcctcatgcctgtgtctaccctgggtcctgcagctgtctgctcagctctgcagtatggctgtggtatggctcaggctactatgcagtgagggtctacagcaaggacaaaggtctgaactccctcctcattgtagtctctggacatgtgtgactctatcccaaaaccttgacaatcccccagatattttgtcattgctagagtatgtacttactcatgggatacaataaaatatatgcaggatgagttgagaacagcagagccatgtgctgggcagagtctgggaggttggttaggctcccacggaaaatgagtgacctacccctacaaagaagctggcagtgtgagtgattagatttgtgccacagctaattagtaaattgaaggagtgggaccacccaagaatactcagaaccctgaatgttagttaaattcacacatgccagtgatagagtatatttctggtcttccgccttagatgccagctcttacgggaacagagccagtcctggttatataatagaatgtttccacaccactttggttcagtatcctaaattgtggctcttgttatggggtagacaggaatgaggttgacataacgtatttggtgtttggtgatggcaaagagtacctgttcatagacacacctggttgtccacctctggctagagaccaacccaagttcaactgtgcagaagtccatgttggcctttactggcccagccagcctctacctgagatcattccctacaacaaggggcccaggattcctcagtcaccccagcagcttttcccaaggaaaaccatctcatgaagaatttgccattgatgattttctcctcactgtgcatcgaagtcaatgggtttattactgagagttggttccttttaaaccttaaccttacactgtatatgatatagaactgtaggcaggccagggtcatcaataaagacatttttggggcctctacttggcttgtaaccacctgcttatccacagtactgtgcacctagcttgtcatcaggcagagtcaccagcagccacaacaaaagggtgcaccttcgtcttttccaagcagcaggcaatgtggctccattttaacttttctggcaatactcacatggattgttaaataatgctgtcaacagtgtcatcttcaaacccaaagcaaacttcctcatcatctgtagttagcagcatgaagacggtgatgatgtgtaacataaacacactttgaaatctgatgcaattgaccctacgaagagagtattccttagtgccctgtctggcaacttctggacagaccaggaggccttggggcttagagcacttcttcagcctcagctgcaaatccattttttcttgtcccttgttcccaggatgaagccacagtgtttcatcaggtacatttatcaggaatctctgtttctgtttatataacaatttaacttaagcctcaaccttcacagtgtacgcatcacatttccatggaaggattgcaggtattagaagatggtggatcatgtcttaaccacaggggaaatgtttcaggatgtttttatagaaactttcactaacaagcaggacacaggattggcagagaggtgggggtaggaggcaggtgaagggtggcatttgttgtgtttccctcttctaaatgaagttataatgacatctgtgtttcaagagtgtggcaagtttggactgagcttgaaataaatacagtttaattggtttcaaataactgaacaaaatgaccattccatgccctgtgtaataaaatgttatagaattaaaacttattagacgttaaaatccatgaaggatattttgctggatgcccatccttcagcattctgatgaggatcttcgtgtatttgttcaatgaataagtgaatcagcagctaaatcctgacctttgatttcctcagttctctcctgcaattgtcactgatgctctcatctccagtcctgagcaaggcaggagttgaattagtatccccttatagtgggaggggtctagaaatagctgtgccactttagaagctaggctttgtgggcttttccgggggatggaatgatttcattttcctgctttctactccacataccaccaagatcagaattctgccctaaacactaatgtgtgggagcctgatgtcctgcctaagtcttgtcaacctctttccaggtgactgaactccgaaccccatgcaccagtcactggccaacattctgcattaagtgacccggtcacccagcaccatccccctgacaccacctttatctctacaccacctgcctcctgcctgattaaatctcctcaaatattgacagacataatgatacctgaagatcccaaatccaaattttctttgcccctttggacattgaactttagattacaaaagaccctgactagggatcctgtggatagctgagtcaattttcttagccccattccttaaatatcaagtctttctaattttccaatgagagcacatgaaactctcaaggttaaaagtcaatttatattaataaaatctttaatttcttgatttctgaatatgaaaaaatgatactttgtgtattttttaattttttggcaaaaccttccaaatttgtggaaagagaaataatattgactactggataaccatgtgctatgtgtaaatattaacggattcaccttagtgggcactgacttgatgatgtttgccacattatattttccagagccttggctctcccaaaaaatgagaggtcatttttcaggggaggaccattttgtgtttggctaacatttaggacatataatttcttctcctctacatgccactgacccactgcatccctggttggagcaagaagagccatgctttccttaataatagctaatggtgaaaggatgtgttgtaacaagagcagaggaatagggaaacaggagaaagacagtcagttgaagagtcctgccctgtgtcagggcaccgtttggccagctgggcttgctaggagtagaatatagaaagtacatgaagtgccatactcagacagctctggctacgttgacaaactggtatatcatggtgcccaactttctttgttagctgggccagcatcataccctctagtatttgctctgaacttcgtaagcacggttgactagctttcttttcctctgcagttatcattcagactgaatagtttctaagaggctcttaatgagaaatagaaggaagtaagttaacttctgtgcataccttggccatatttgcttgacaaactgatgtgtatactaaagccattatgggtgtgaaaggcaaaagtataagtgctccccagtatgacctggctattttgtcttacttctatatttgattgctaaaaatatatgttcttgggtcaaaaaactcactttaagggaaaaaaatggaagaatattaataaccaaaatagaagaatattaagaactttaacatgagatgtatttagatcaaaaccatctctttttggatttttgcgggtgatttctccaacatgtttagaactgggttgctattcacccaaaggtggaaacttttgatgttggggaataccactgatgccttaaagcagagggtaaaaggaaaagactgaaattccaggctaaaatgaggagagcatggccaccactgagcccaaggtagcattcaataaatactatataaattactgatttatttctacagttggttgatagaagcttactatgatctgcctaagggtgcatcaaattcctctggtacttatcctattcttgactatcacttccttgggggcagcagttaatcaggtagaggcttatcctgtcaagagagtaaagggagctatggaggaactcgctgggaggagaagctggtcctcagagatgcttagggtttaggaccagtaagaggcagtctccacaccacccacatctgattcttgtctccttcttctctgctgtggtcaggagaaacagtttagattagggatttcagagcagtggtgttgaactttgtcaaaactgcatttgaatcccatttatgaattgtgtgatttttttaaggttgagttccccagaagtaggatgctgagacaaggattcctatgaaagtgaattattagaaaatggtccagggagaaagcgataggagagtcagaaaatgagacggggaaggtaaagaaaccagacaaggatacaatatcaagtagaatccaacagtggtgtgggtgggtagaagtatctgtctcagcagattttgagttgtccagattatcctcagttggtggttaaggttaaatttgcatcctcacgaggatgcaaatttctacacactatcagttgtccaagtgcaggtaaagctggctccagcagcctgagggcagccgacagagagacacgggtcctgggtgtgggagtgaaaccacacatgaagcctgcatgtaaaaaaaaaaaaggtaaagaggggctgggcgcgatggctcatgcctgtaatcccagcactttgggaggccaaggcgggtggatcgagaggtcaagagtttgagaccagcctggccaacatggtgaaaccctatctctactaagaatacaaaaattagctgggcagggtggcgggcacctgtagtcccagctgctcgggaggctgaggcaggggaattgcttgaacccaggaggcagaagttgcagtgagctgaggtggtgccactgcactccagcctggtcaacagagcaacactctgtctcagaaaattaaaataataaaataaaataaaataaaataaaataaaataaaataaaataaaataaaataaataaaataaaataaaataaaataaaataaaataaaataaaatagtaaagtaaaataaaataaaggcaaagagatcaatctacatcaccaaagcactgacagcatctgctacagtgactttggtagtttcttacattctctgagcctcagttttcttatctcttaagtcagaggaaaatgacttgtttaaaaaggcttcaatgaggtaacacaagtaaagcatgtattgagattactacacaggaaaagcagttgctgaatacaattagtcaactggtaattggtaataattatgtaaaattcctataattatagggagcgctatacaattattatatataattcctataattggaattaccaataggctaattgtattcagtaactactcttattgtcctcaagttgagttattattgcaagccctgagggctgaataaacatgcaaactaaactgacatgtagaattttatttataacaatatatgcctaaaagaagcggtttatttgcacaaggaaattttggaagctacagataattttaataatgactacagaaaactatcttgaagatgtttctaatgtttaagacataatagcataagcctttataaaatgggatactgttatgtagttatagttgtaagaatcagtgtttaaaggatgggtttgatgaaattgtactactctagttcctgtgcttctaataaaattaaatctgattaatacagcaagtaggtctttggtgagttgattctgatgctgggagtgattttcttaattcttgctcagaaagccatccatgagaattaaatgagatagcatgtacaatacctggtatagttactggtaagaggttttcagtagagaccaatctcctctttgtttaccttctcatcaagagaggaagaacaaggaaaattaggttgcttttttgagaaaatactttaggccaattacaattatctgaaagtagaatgaatttctaggttaggcaagactagagttaaaacgtgggtgtgcagggctgacctgccagggtactctgtatggaagtacatggaaatgtatgcccaaatacagcttcatataattgttttgatcatacacagtttccacatgagattatatttgaatgactaattcagcaaatataaaaaaggagaaaaccagtggacaagatgattcctaaggttcctttcttcctggtctatgccctagtgtattatgaattgatattcactggaacacacagttactgctggagattgagttataaaaacattcaaatgggttactccattatatctacttaggaaatttttttttaaaataactgatagatgttcagttatgcgaaacgaaaggtatttctggctacccctttatagttgtgtacatgactgcagagccatcatttcatgcttacttccccacattcatgtaccattttctcaaaggaaaattattgaatgaacttgctagttttgattctggggtttgttttaaacaactgatatttaaatccacctagtcctctttagctgttctcctaggaactttaatattaacaaacagctgaacttatacattttgtaaaagagttcagacaatgaattcattcttcttgaaatgcatggaagtacccaggtgctagctacacccaagagccttttctaaatacaaaaaggattgacaaaccaagcattcatcctgtctgcgtccaacagttcggaatcaaaccatgaacttgctgttcctctgtttgtggttagcttgtttgtatatttttaaggaagatgattcaatgcaagaagtagttttatatagtacgttaagtaaatttcctatacgatatacttaatcagaaaaatatttttgaactagagctcacagaacatatgattacaatagttttcagaaagcaaggggctaaatgaggatttctcaaccttggcactattgagattttaggttaatttatctatggtgggaggcgtgtcctgtgcattgtagcatatttatcagcagttgtgacctcgtacccactagataccagtagtcccccttctcagttgcaacaaccaaaacaactatagacattgctaagtgttctctaggggtcaaaatggctcctgcttgagaaccacagtctagatctggtagttgcatattgaactgacagtccccaggattgttgtggggatcaaattagataaaacttgtttatattttttaaaaagtaaaactaatacatatagttacattacacctcttcttttcatttgttactcatctaagattttttgagccagatgatggagacccataaataaattaaccttaagaggctcaaaggtttgccaggtaaacaaagagttagaagaaaaagagagatcatgtcagatgtgccttaatgaatgtgtgtgtaacatgtacaaaaagttatgggaaccccaagaaagaaaagactccttttgaatgaaatcagagaaaaccaactggaccatacagttgaagctctataacaggaattaccaattaactaattgtaactaaatactcttttatacaatgtcatatattcatgtagtttttaaatctagaagtagttaaggttcataattgtcatttctcagggacactactgaagtggtatcaaatctaaatgagcaacttaagaattgaagttgtcagacagctgttaattcccctttttcatacctgctccaatgatagccaacaatcaaacaaaaataataaaataaaaacgaaagcaaaaaatacaactcagatttcactacgtacagcaataaatatcagagacattagggaataataataggtcaaagcagaaattcattcctcagcatgttcttcaagtggaagaattaggtctgttttagttctgttgattctaaaagaaacattcaggctatcaagaaaacctgttttaaactctaaatctgacactatagatagatagatagatagatagatagatagatagatagatagatagatagatagatagatagatgatagatagatatagatagatagatagatagatagatagatagatagatagatagatagacagatagatagatataattctgcctaagtaattatctgctggtaccaaagagattgacaaagagattcactaacctaccagaatttcccaaccttgttccagggtattctacattaaatactcattaccaaggaaattccacataaaagctgtcatgcttgatggagccatatttacatgaaacgttgcagcattttcttctttaaacctcttctacaatttgaccaattccatgttccagggagtactcagaggctgattaggacatgagttgttagcatgtgctgcactaatggttatgagtcacatttgttttggaagatcacccttaaagcctgtcactcatgcttgtttatgggaaatacaacaacttaaacatcagttaacaaatccccatgaatgcatggtcatatttgagtgcttctaacaaatgcttcctttcatttctcccttgacagccctaagaattaaaggctggtagagcaaactgggagacatccatgaacatttattaaaggaagcataggagagtatgataactgcaaagccagctgtttatattattggtgtgagattaaatttcatcagtcttaaaacctgctttttaccactagagaaatcaatctgccatatttaaggttacattaacgtggaacattccacgtactgaactgtcacatgcctttaaaataaccatgccatgctgttttttttttttaaaatcattacacatgaaacaaacagctgacaggtggggatctattggtatattcaagtttttcatgtgaaaatttcccccaatattagtggtaatcacaatttgattatgagaaacaaacataccatatataggcagaactatatatcagtagcctttatatttgacagctcactgtaaaatccatactatgattcagtgaacatatttatgtcttatatctgggttgatctggttgccttcagctttcctcacttgaaaaaactatacttaaaaaactgtaatttaatgttaaagttaattaacacagcaaatacttattgatgacctattatttactgggtactattttcggtgcttgcaatgcctcaatgaacaaaagagataaaaacctctatggtcatgctgcttgctttagtgagatatatgtgtgtttgtggggtggaggacatgaatgtgaggcagacaataggctacaaaaataataaattatctagtattttataaggtggaaagagctatggaaaactgccccatttgttcctcatctgagtatacccaaaagttgatctttaatattttatatgagtctcctaggttctaaatgttagaaactaattaaaaataaattgaaactaaactaaatatctttgtgatctctctggctagaagcctcaggaccagtcctcactgtttactgatgaggaagccgaggcccagagaattaaacgatgtagccaagatttcaagcagttactgtcagaggtaggaccaagacacacaacctccttctctagtgtgtttttctcaatcggttggcatttaacagcaagtgttttagttgaaaaaatttatttgaaaatctgtttgaaacatgacaaaataggaaatacctgcttattccctcactgcagagtggtcctcagcagaaagaagattttgaagtttatgaattatgttcagacaagacccttataaaatcactctcctctctccagtggcagaagcgtggcccctgactcctcacccaccttcattcatctttcgtattccttgaaaattaccactgagtattttccttctgcttcctgcagcaccagcagaaaagatgaggatgcgtctcttgattgccattacaaatctctttcttatgcttgtttccattcttattctgcacataacttggacttggccatcattcttagagctcctctaaattgtttgattaaaagattgtttataagtccagagtcagaacggaattgaaaaggcactgcacattatgatggagaggaataaactccagtcaaaagtcatggcttctggactcaccaccctaaggcagcctcactggaacttgcttttccaactgtcagtggagttttagaattttcctacttgcaagcttgttgtgaggattaaacggttaagagagattgtgtctgttatggaattgtgaaaactgtaagttgcagtccacactgtagaaatcttagttacctctgccctttctttctctagagacaggttgctagtggaatagacaagtttgccattaatttgaaggttgcattaagcatatattatgttagtgaagttggtcttctgaaagttggaagggacctcagaggtcctgtattagaccaactgtggctgttccttagaataagctggaagttttctgaaaaatacaaattctgaagcctcatacatagagattctgatgtggaagatctggaattgatggcagcagcggcccatctggagccgctgctgtgaagatgccggctgtagtgggggaggtgcggctgtggttgtgccctccacagagctgccaggtgggaagcctgacccttctgagttggcaggtctgaagcccagtgctcttcaggcacagttgcagctgcccatctgtgcctctagacctgggcatccccgtgctctcgggggcccaggaagcaccccctgctcctgcaggcttggaagtgcctgctatcactccctggcctctccctgcacctgcacccagcacccgctccggggtgaagcaaagtcatggccaagcctggatgctgtcatgacctggtcaggtgtgcacacactcggagcagtgctgacacaccagccccctggcacataggcactctctggactttggacaccaaccagcatgggagggagactgagagggcactaaggggtggttcagcgcaggcctgcaggcgccccttggcatgaacagcctgggtgctgtggatgacatgtagatggtggcagaaggcagacaggctcctgggcagaaagaggccagtccccagtgaagctccaccttcaagccagggatggccggaagccttgtggctgagctatcagttccaggtggagtccttggctgggagtgagaacttatggtgctttatccaggccttcccatagccacccatggaccaataagcacacccttcctcccttctgatctcataaaatccctggacttatccaaactcgggcagatgtcgggatgacctgcctatggataagagctacccacttcaggtctcctgagaactgtactgtcactcagtaaagtatttcttcaccttgctcaccttccagttgtctgtgtatctcattcttcctggatgtgggacaagaactcaggacccacttaatagcaggactgaaagagctgtaacacgaacagggctgagacatgccttccctgcccaccacattgtaggtgacaagaacagaagagctacagccctttggggagcccagacctgtgtgacaccctctttgggggctctgcggtttctgtcatctccatgctcccaggcgtcaccacattcccctcgtccagatgcagttgcccacggtggaagccatttgcgtacatcagatgcagccgcaggcttgcatggagctggtgcctgtgctggtgcctggagctgctcaccccaccacggcagctggtgtacctggctgtacacagtggctgaaccccatgcttacccactcacgtatccctcattgctccacgcctggcttgcccttggcaggcatggggtccaggctggtagcgcaacccgagcatagcctaccaggccgttggcagaacaagcccattgggcccgagcaaaacttgggcaaatgtgccaccagccacaaaaaggaaacacaaaagtttccagctggaaaagcaagacctgaagaatcctgcaacagaatgatgctctggagtgttttctgtgttaggtgtgcttgtttgtttgactaaacctccaaacatgagtctgaagattaaccagtttgggaagccttgcttcagctttctactgacattaaactccttctcctctcccatttctgtcttcacttagaaatggaaacccactaattactcaagatcttaccttttccattcagtcaactaggcccttgcacccccattactttgcgttccaccttgacaattgctattgccaaacatcggcattaatctattttgacatcttctttccacctgctgccctctagtggaagtgctgacaagcagcaaaatatttaactgggaacagcaggaaagtgaccagtttgagctggccagttcacacaagtcagcgcaggtccccagcatgatgtctacagactacagctatgccagaaatcgttaggatggcctccagctgtttggacactatttgcacacaagttacatttagagcagaactttgtaaagaccctggcatttattcaagggctttttaaaggtttcaaaaatctacctggaaaacattacccttgggatatttttgtttctttgtccctcattttcttcttttgtcatttacccaaattcttcttcttgcaaaagaaggtggttctttcctgccttccctaacctttgaattttccaaatcttgcaaaaaataaagatatatatatctttaaataaagatatatatatatatatataaattcttacagtttagaagcttccagtcaccaggtgaaaggaattcacatgaactgaaaattgacaatgtaaaggacactgtgttctcctactgttcctccaagtctctttgcggtccgttagtagtcttcttttttccaggagacactgaagttaagagagtttaagaagattgtagtatgtcacaaagcaagtggaaaagctagcactagaactcaggtctggctgatggaaaacccttatgtattttttttaatgtgcttctttggtgtttagtgattatttagtcttccgtgaagtaataaataataacttgcatggtaaatgttattaaggctcgaggtactaaatttatagcaaaagtcattcagcttttttttaaatgaatgtttaataatcagtgtgtctctgcataatctccaattactccttttagcagaggaacatggcaggaatgcaggtaagtttgggtgggaggaaaagacagcaaaagccacagcactgatgcaaagttgagactagatttcacagggcagatgccgtatactccctcaagctttgaagaaactaaatagttatctatgttaaccaatagggcagaactcgtactccaaacaccgacataaaccgtgtgtgtgttttgtgtatgtgtgtgtcttcccccacagcattctgcacaattattaaccctttttgtgtagtggtttttcataattttatccttgattgttaatatcatggtaagtgatgtgttataaatatatttttccttaagtatcataaacaatctaagatttcatttggctgatttttcttttcttagtattgcatatcattattgctgttagaacactcatacagattattcagcttcttaactagaatgtatacacacacacacacacacacacacacacacgtgcatgtacagaactgccttctttctctttgatggtagaaaatacagctctctatagtaagcaaatttgctttcagtctcagacatacccttcattctctgcatgactggtaaagagcggaaagagtaatacttaggatctggattccagttccctgttctctgaccatttaaaaattttgttaccttggccaggtaaatacagttctatgaacgtcagttgtgcctcaattgagcaggcttgtccaaaggattcctcaaggatgaggtatcctttcagctgtatgagctgaaccttgatttgtgcaatagtttaagcccctgaatagtcagataaaaatcatgttaattaaaattaaatagctattggtaggatctggttttccactggcttgcatgaatgatgttttgccctcctttctgatactcagctcagaggattccttccattgggttttctttcttgtagtttttctggttcataaatagcctatagacaaacactaaactgttacaggtaaaaggaccctagattaagccttttataaaacaaatagtcctgtgtaaataatgacatcttattttatgtgtgtgaatttgagttttaggatgtagggcatgtctgactagatagctaaaggctgagctccaggcagccagctgctatccaatctccacacctggaatgttccaaaaaacctcctgtgttttctttctgcagctaagcactgatgagcaggatttaagaagtacagccacacactttttgctgcacgttttttaaagtttgttatttttgtcatagattacttgttttgaatcaaaaatttttaaagaaaacttaatctcccaaattttaacccccttgaagtttcaggattccaaggaatatttttattttaagatgcataaaatactcagtacatgtacaaaggtaatgcttataagaaacttagaaaaaaaaaaggagctagtaagattgagaaggggaagaatatctaagctaacattactaacctggcaactattataggtggctggatagcatgaaggcataaagctgaaggcagttaagaaaatagactggatttgaatcctggctctacctggattagttttgtgacctcagagaagttgcttcccttctctgtgcctcagtttcttcatatgtaaaaggagataactatagtgtctaacacacagaattattgtgaggattaaataagttaatacatataaagaaagtccaaaactatggcacacaaatgtttaatatatgtaagctattattgttataaaactaaagaaagagaacccagaagacattcagtttggtgggattcagatatatgttttcctttcctcctcctcctcctcctctccttctctaaccccactatgcttgcctcccaatctatccctgactcctatttttcttcctcccaacttaagaattgtcactaaaaatatttagaagaaaagaaaatgtgcatacttcagggggtgccaagcttttgggtaaagtacacttttcagctaacatgactgtatccaacagtaatgggctttatggcaagaaaaagcttttttctcaataaatgggttttaactttgtaatggattattctctttgcatgggtaattcttctggaagatggaaattggctcgatgataagataggacagttggatttagggatctagattaagggactatcatgtatgcttttaggagagaagtttaatctgcaaaacctacttgtcttatttaattaattgttgctcttagctgctcaattttgtacaggtgacttgcatgaaagcaaaatgtatgtcaaaatccaaaagcagagtgaagcctcgggacttcagtgcttttgggtgtctttccagacctctgctcttcccccaccctcaccaaggccccactgacctcaaagggcccttcttgccaggccgtgaattacgtctgagccagagggctgggactacagccaaagccaaatgaaggtgcagaatttaggactaaaaaaagcctgagcacgtggcactgggtatagcagataaatttgttggagaaatggtttataaataacatgaaaagggaaaggggatagagggtcaaaatattgagctgttgagagttgttcaatatttgaggtcagtctcaccatttttaatactgaacccaaaagtaatacacactgaaaaaaaaaaaaaactcactgaataaaattaactacagctgggcttattttttcttatcaagacatttgtaagtttggcagcaagcatttttaaacaggatctctattatatgaaataaatttaaaaacatgtgtctacagtcaggacaaacaagtgaacaaaaacaaagcaaaagcaataaagaagccccatgaaggcattatgcttttctgaggacagtataaggctaggatactgcagaaactgaaatacttagggatcttattgaaatagttttcttttcctccaaacaaagcaaccatctcagagggatagatgggctaaaagacaaggaataaagtaaacagaagattggtaacttgggaggttttcttttcccctttctctttttggttttgatttgcttttcccttgttaaagccagaaaggataaattttggtccagaactcccaagaccagagggtcagggaaagccaccccgaggctggaagctatgaacttatcgctagtctaaactccacctccttcttccctgggagtcctgcacaaatataactgcctgatctttctgtttactggcaaaggttttgctcccttctctttcgtatcggaatgtgaacttggggaaagatttggggttttttttgttttttttttgtttttttaagaaacagagacttgacttattcctcccacaaactcttaccctggcacagggagaccacaaactaagtgaaaacaaggtaagaagcttagagaaatgggaccatatgccctccccggagctgaaccgtgttccctgtccaccatcaccttgtcttcccatgctactactccactcctgtctcttccacactctgggtcacatgtctaccccttactgtgagttataatcgcccaggaagggtaacccattgactgagggccaagcttctgataagtgaatgaacttgtcttttctcctggccagatatctgtctttgccagagagggctgagtcagggagactaagattttcaaggtcaaattgtatattgtttaaaattgtgaaaatttgctttgtgcattgaatctcattttcaaaataaaattatgccttaagtcagatcatactgatgcagattctgcagatgttaagaggcttccatgattgtatttgccagctgcaggtcaggcagtggtggatggtggtaagaagtaacctatacttttggctgggagctgtggttcatgcctgtaatcccagcgctttaggaggctcaggcgggcagatcacgagatcaggagattgagaccatcctggctaacacagtgaaaccccgtctctactaaaaatacaaaaaaattagccaggcttggtggcacacgcctgtagtcccagctacttgggagactgaagcaggagaatcgcttgaacctgggaggcagaggttgctgtgagcgagatcgcgccattgcactccacactccagcctgggcagcaaaagcgaaactccatctcaaaaaaaaaaaaaaaaaaaaaaaaagtgacctatagttttgcagtagaattttgaattcaaactcaggctttatattttctccaaagtaaattgtattttgttcattttaatccattggttgactctaatgagatctttctgactggaaattctgccctttttttcctccataactgtattaccagttatctctcatccatgtgtttgataaatccatatgaatgtctttttttgttttctaccaaaacctttataacaaaacaaaattcatagctttgtcaactacacttgaaaattatgccccaggcttttcaggattctgtaattaacttattgagtcatttgtttaaccattggtgaattcatttatctttactcgggccacagtaatgtattttacttacaacatattatgagaaactacatcacctgcttcaccgaaattgaaaaacattagatgaacaacactgccctaaaccatatttcaataatcctttcatgaaaggaaaggaagtacatttcctataatgatttgttcttagtgaagccatgttgactccaagtgacctgttgtttcctttctgggctcatagaaataatctaaccattctaaaatattgatggggattcaggtcaaaggtatagttttaaaaattcaccatatttaacctgttaaacattcagtatctcctaccttctgtcttccaaaaatccaaagaaataaccatttattgttccgtttatgctttcagtgtctaggacatagctaatctgatactgaacatttgaacttatcgttagctttgaaaatatgccctattgtcctattggctttatactaaagttttattaatacattccctcaatagtctccagtctttgcccaagaagaagaaaattctgtaagagtttctttttaccttcctttcttctctgagtggaataatcttttttgttgtcttcatagtattttagagttttgtgagatcagacaaaatttacctcagcttataactttatcttttaagtggaaaaactctgaactattgattattgtgtcatcttgaaaaaatagtctatggaatatatataagtagttgtgttatttttttcagtgttaagttgacctttttcttttagtgcattgtgaatatttaaaaggtcatttgtgcaacatataagaggattgacaggtttccatgcatgatgcttaatgtggagatgatttctttccatcaagttattatgcttggaataagtaacacatcttaaaattacaaccttgatgtagcaaatcatcagatgggttaccattacatggaaagagccagtgaaataaagaccattaagttcaggtagacagagatggcggtgagaaattcacagccaaagagggccatatggaggtgaaaacactggtaaatggctctgggaccctaggagtctacagtaagtcattgggaagttggagtggagaaaggcaacattagctaggtatttcattcattcctccataaatgcttattgggagcatgttgtgtgcctggcatcatcctagcttcactgaaaagaatgaggaacatataaaatgtgaaggtgagaataagtgagaagtaattgctctttactctcaattatagctgggcaagtacatatatgaatatgcttttgtgttctgaacacacactaagcagttggtcaaagtattaagctagagacaacttctactttcaaatgtagtgtttcaaaataataataataataaagatttcaggacagtttacatataaccatttagagatttaaggattaaaatcaggagggaaggagaaatgtctctgctggggaaatttttttaaactagtgttttctactcagctactcaatgtgatttcttttattttcttccttccattgcttattggcatttattgtggggaagactgctgtgttggcagcatgagagagatgggaatcaagaaaatggaaacaccattcaatattcaaaagccactatccccttaaaagcaaccacagatcattcagttttgccacatactcagattgcacactaactggaggatgttaaaaagtgttctattacaaccagttatccagtttttgccacttaaactctgctgtgagaaatgtgactgtagagcagccttaaaaagagatcatcttgatattaagcagtgttactcatacatgcttgttgacattctaacaggtgactttgaatggatcttcaggctcagaaacatggttgtgtccctagaactggtgaggctggaacaaggtgtacagaagtgaaatgaccacttgctttctctattggatttctttatccagctgtgcaattgtttcagggactacagttgattttcctgatgcaagcctagcaacttgtttttcagttcagcacagtaaaatatgaacaggagagaactccctgttggccacccacctcacaatctttaaaagggaactctgtacagaagcattctgcattaggcaaatgtacacttctgcaatcaaaatgaaaaacacttgagctgaatcgtttttcgttagctttagtttccagccctgattaaaaagaacacagggaaccctgcaagtttaagcggttttggcagccgaggaaacagctgtgacattgtcaagggttgtctgtaggagctgtgcaggctgctgacagcactgataatgcccagaaatggggcagacgcttttcgcatttggtcatcaaaggagtggcagcagctaggttcaagaagtgaacttttgaccctgtctgagacaactggctctcgtggatcttgttctgtcattctccagtctgattttctctttcagaacaagtgggtaggatctttggtttttaaactgtttgactgttattaaaagtaagctagttcttatagctgcgattggaagggatggaaggtgaggaagaagagctggtatttcccactatcctgcaggggtggggaaatctatcaacgactgttccactaatctgcggatgagttatctagggaatatcatgcagttgccaaagttttcagcatctaaaagcctccaaagttctctctgtgagggtctacctcccctgtctccagatccttcccatgcccctcagactcagcacttgtccactgtccttgctaccagggaatccctctgcagcccccttaccctcctgcccctcccaaaagagctccagactttgacctttctcttccacctcaacatctgtttgtgtcttaaactgatgtccattgaaagaaacagataaactaattaatgctgagatatgacttatgaagtattatgaatgtgctaactctctcaggggtatgtgcattttaatagaggaccagcagtccaaaggccggtctcactccactgtgcccctctaacagcaccgagtctatttccaggcagccagagaccaggcctgagaacttgccccagaccaccagcgtccccactgagaaagcaagcagactcaacagtttttcagtgtttcagggagcctgcagcagcaatacagttccttcaaagggtctgtggattctctcagctttcctagtaggttgctgtggtagtttttggagcaaaagttcacgatgtgaatcttcacatgctgctctttgtgccgagcaggtgcttgcaagctagttctgcccctatctgccatcttaatcctaacatctcccatgtttttttaatttaacttctattttggtttcagaggtacatgtgcaggtctgttatatagataaattggatgccatgggagtttggggcatacatgatttcatcacccaggtaataaacatggtttccaataggttagtttttatgtcctcacccgcctcccatcctccacccccaagtgggtgccagtgtctattattcccttatttgtgtttatgtgtactcagtgtttagctcccacttataaatgagaacacgcagtgtttagttttctgttcctgtattagtttgctcaggataatggcttccagcactatccatgtggctgcacaggacatgagctcattttttatggctgcatagtattccatggtgtatatgtatcacattttctttatccagtctactgtcaatgggcatttaggtttatcctgtgtctttgttattgtgaatagagcctcagtgaacatacgtgtgtgtgtgtctttatggtagagcagtttatattccttggattgttgggtaaaatagcagttctattttaagttatttgagaaatcttcatcctgctttccatagtggctgaactaatttacattcctacaagcaatataaatattcctttttctctgcaaccttgccagcatctgttatttttttgagtttttaataatagccattctgactggtgtgagatggtattcattgtggttttgatttgcatttctctagtgaatagtgatcgtgagtattttttcatatgcttattttccatgtgtatgacttcttttgaaaagtatctgttcagggacatcattcctatgaaaatgctagttaattatacaagtattacttgtttccaataatcgattttttaaaaaaccttataatcaatattgcattaaaattttcagctgtgtgattccttatcattttcttggatgcaaatgccttgtgtcacgtactatatctcataaatctatattgcatctaacaaagtgctttgtgtaaagtaggcaattaataaatgcttgtttaatgagtagatttgtttttgttttattttgctttctatgttttcctaaggatgtggggcattaggccaatggaaactgtctctcaaaagttcttatatataaatattgatgtcaaagtcactatttttgtacaaataaacacatttacctaatttggtgagcatttatagagtcctgcctatattcaaggtccctgtgctgatcagtgggcaactgaagaagtatgaggcactgttactgctgtcttccttccctaattgggtcctataccttatcttggtacagctacctcctaaggaggcccatctgtgctgttgagggtacatctgaaggcagtgcactggaatgtatagcctaggactggaatttggagtgaggccctgagagatcatacacatttttcacttgtgggggaatgtccttaagtagaaatagatggtgatttcagatatttgatccaaacctaacttcctcatttgaattgagtatgctaataactattcttgaggctctggaatagtgatgacatttcctggttgggaaatcagatgctgatttctgaagcagagttttaaagttgaaagatgaaaagggaacaaaacaataaacacaaccttagactgaagggtcatttttctagtccaacttccctccacctagctgccacccaagattgtccctcagccatccttagaatattaaaataaatccattgcagtgctcaaatgacttgtttctatttgaaaatccttgccattggagaatttttctatatatcttaccttaatggctctccacgaattttgtcaacagtttgtcagcaatgtactcatgaaaatatctcatatctatgtatattctatcactttagcctccttgacttctagaccagcagttcccaaacttttcaaatgtgaccccttttagtatcaacttctgtttataaaagtacaaaagccctcacatcttatactttcttttatgcttttatttattgagatattagacaacacatacttgtaggtgacatggattcttagatctaaataactccactctccatggtcactgtcacttcaacacaggttgatgcagtccttagtttggaaaacagttttggcataaataatcccaaaccttcctatcacttcttggagcttttttcttcatgctttccttgcatctttcttaaaatgtgaagactacattggatatattattaaaataatgtcattattagtgctatgtttaaagctgaccttttcttcctagccactgatatagcagtgccaactgtggactctctttagaatgaacactttagtaataataagtccttagaacacaaacactgtcacttgtaaaacacttttctatacttggtaacctacacagaacagcggttcccagactttttcttttttttgtcttgtgggtcctttatatattcttacaaattattaaagactccaaagagcttttgtttatgtgaggttttgttattgatacttactgtcttagtaattaaaactaagaaaattgtaaaacaacacatcccattagctgtcagagcatcatcatgtcttgtaggctctggaaaactccactgtacactcatgaagaatgagtgtgaaagagccaaatagtagcttaatattattataataatagtttaactttgtgagctcaccaatataatacatattcatgacacagtccctaacatctaaaaacttacaatctaaggcccaacataaatactaatagatgatgctaaattctggcttcacagtgcttcctacaataatactaaaaatatatgaatttagacagaggccaaaatgtgtttattaaccacttggctttgcttagtattttgttacccaccttggagaattgcctctgctgatttacactttataagaagcagccctatgaaattttttatcataagtttaacaatgatgtagaacatactgtttcattttataatgatccttgggcaaaatgtataatatctgtgggagaaatgctcaatgctgcagtaaaaactatacttctcctcagaatcaggtatgttcttatatggtcagtataaatcttataactgtgctttctgatctcctttggccaccaggaagacaggagctgacaatccaacttactataaattcttcagggtctgatgtcattatttctataagattttccctggcattatcttatttctcaggtctcacttttcctttgttctgatttatttttcttaatatgttttattgtgtatttgttaatatgttttgttgtgtatttaattgccaatggggatgaatgaataagtgagaaagaaagatacttgatccatttgagtgggactgcttgagtacctggagtggtgcagaccaagcagggtaactgtatcaggtttcattaatgaaatgggtcttaagtggagattaggaaggaaaggaagtgggttgctggagaggcggggtgttttatgtgacagattggctgtaataaagatgcagctgtggagtgagtgagtgatgtcctgagcacagtaaggagatctggctgacgtggcactgcacctcattgccttaatatcttttcatttgattgaagaggcagctgagggataggtgctcttggaaagtggagtaaccatttccaattaaggaaggactctcacttcagtttctaaaataaattagaagggagaaaatatgaagtctgagagatcaattaggagaaagttctggtgctacatatagaaataggcttatccgcatatgcaggtgagagtacgaagaagaatctgtgaatggcagtcattttttgtagctggttccaattaaaattgattctctataatgactacttattggctgctgctcaccaggtctgcctttttcatcattgtctgcagaacatatcacagtatacagcatagagtaggtgcttcataatgtgttaaatggatgaaatgggttcctacctccaaaggagatggaaaaaaaaaaacaggcaagtaaataaagtaaaatatgtataaattgctttaagaatgttttataaaaaaggacagtagcccaacagcattcacagtaggctggctggagtagcagtcattgaagaaacccatgaaaacagcggcagaagcaaatgtgcagctgctctgccttttcacactgtagggcagcacacgaatagtcctggagcaccagggcccttagactgtgggatttttaagttacctagttggcacagcattgactcctcctctggtgtgattaggggccaggatacaataaacatatgttatgttggaactttgatgccagcctaaacttgccagttcagtgtttgtggttgcaggtagtatcagctcctctcctgatatgattgagagactgaggtccaaggcttcaggttgaacagaattgatggccctaaggattgggttagaactcttccaaagcacttagcaggaagccagtttacttttcttggatgccagcttccaagaaaagatcagtcttgagcaaaatagtccttcactctcagctcagaagcctaattgagagggtatcctataagtaacacagcccactctgctagtaacctgttctacttcaacctgtaaggcccatgaggctagccagtgacatcactacaggacacagtggaggatgtttaggaatggctgggtgatgaccagggtgcagattgtgtttactcaaggctgattgagaaatactgttttcagtggtgtgcttataaatgtttaacagtggtgggtggaaggggggctctggcttgtagcatttttctagtgcccatggtgtaaatactcccaacatgaccaactttaagttaccaatgtgattgaaagtagagtttggaagcgaggcacagtagcccactgttatgtagtatttttgccatacagatgcataagagacataagtaacctgaagaacatagataattattaaatgtagtaaaatgatcatgaagtgacagatcttgagtgttttatcacatttgtttttaatataatttaattttaagttgccataatttaatttgtaattaagactatgttaataattggcttatggaatttctgagaattcaaaaaccagtgcccataggtggatccagtacaccactaggtaagaacagcctagaagtacttctaggctcttgttctgaaaggtgccaagactggcatccatggttccagtgccagggtcgaggaaagacttactaggtcctgcagtattgctcccaaatctctttcagtggccagggaaattatcagcctgaaggcaggctgaatggcttgcttacattcaggtcccagtatctacgattgacaatcggcttcatttgtaagtaccagatagtgcaactccatgtatccaggaggctgggaggtactgagagcagactgatagtgtcaagagacactgaaatgactgccagctctctcctgccatatccactactaagtgagaaattcagtgacatagtcactgaggactccaccactgctgggtgttggggagggcacactgagtatttcaagacaatccgggtaagatttttcttggagggattcaagtacaaaatagttaatatgcagaaatgaagcagaaattattatacctcagaaatgagtcagataatactaaagaaaggaagaaaggaaagcatgacttgattcatgtctttaatgatgaccaaagaagttgggtctttaaagatgacaagagaagactgatcaggtagcagtgaggtggaaggggaaagatgagagaggggacattcctggtagaggaagcaaggtagacaaagtgtaggaatgtgaaagagcataatgtatgtaagtattgttcaggtgacttcttgggtacctagatagtagagagaaattagaggtaagaatggaggaaggggagactcagggccaggttgttgagggcattttatgccatgctaaggagtttccaatttttcctttcagtaatagcaagaaacttaaaatgagcaggggtttgtgtttttgaaagaactgggaaaacacctctgggcaatccattacctggggataatgggtgaaatttcccaagttagtgcacaggctgctgggtagggcttgaggctttcctcttgcctcctatttcaacactgtggtcttttaggacttgtcctcaacatgttcttaaaaggaatgtttgctaactgccaaaacagtagtcttcatatttattctgttcctttccaaaaggtaaattgaaaaagcaacataccctcagccaagagaattaatcttttatcacctaagttactgcccactgcctttcagttttaaagttaatttagtgtgcataaatggctatgagcccctggaactctctttatgtttgcatcttaaatttaccagaccctccttctgcctctagttccagaattttctttgtcttattttcttcaagaaatgtatttctttaaattggattgcaaatttggaatacacacagtcaaagccttttaaaaccattcttttaaaaaaggacaagtttcttgagaacatttttaaaggaaaaagttaaaatagatgtcaatggaagatgcaaatatgaatataaaatatgaaaagcatctataggctggagcttctcagtagagctctacttcatttaaagtcatattatctggcaccatttcaaagcttttggttacttgattttgtagttagaaaaaaagtataaagttgaaatattgggctctttacatgaccattttgctagtagcagtggatgaagcttttctctaagagatcaatagctttagtgtaaacttggtcaataccttattggaagaggtgactatgtcagattaggtagaaactttaaaagccagcaagtttccaaatgtccttctggaattggcctcctagggccatgtggaccagagagatcttatcacagaagtcataaactgatatccgtgagccaaatctagctcatgggcatgttgtttggcctacagcacattttttttttttttttttttttttgagacagagttcactctgtcacccaggccggagtgcagtggcacaatctcagctcactcaacctctgcctcccgggttcaagcaattccctggctcagcctcctgagtagctgggattacaggtgcccaccaccacacctggctaatttttgtatttttagtagagatggggtttcaccatcttggccaggctggtcttgaactcctgacctcgtgatccacccccccgcctcttggcctcccaaagtgctgggattacaggcgtgagccaccacgcctggcccacaccacatttgtaagcagatgaattggttatttttaaaaatttgaagaatttaacaacaaaaacaacaacaacaacaacaaacttttgtgtccagcttctttttttttattgtcccaatagttaaggacaatcctgggcctgcattctttgaacagttggctagacttaagtagctgctgccccttttagatggggcaaacattctctactttttcacagtccccttcaagggtgcttcagccatttttgctactcacttgtcttcaataaaccaaggtcatgtttaaaagattaaataacagttattgcatgctcaccaaaccgtcacaaggaaccagacttgtgtaccagaacagagtcctggagcatatctctgttaggctagacatcactcttttagttatgggatcatggaaaggtgcagaaagttccagggaaggggtcgggagggatttggtgagtgaggcacttggaggcatgggtcaatagcttttcaccagctagcatggaagtacttttagtgtttaaaaacctatggcacagtgggatcttctaggaaagtagaccctggagatggagattcacatgtagcacatttattaggggatgccactaggatcaatatctgtaaaagagagagaaaggatgtaagagtgggcagagggagaagttgagctgcaaagcaggcccagtgccagcctcaactggctccataaggagctctggctctggaatgcccttttatatttgtttcccatgggaccaggatggctaggccattctactctgacatgcatcactcactgaaagtgggaagagtcttgctcttgagtgaggaaatcccctgctactgaggcaatccctcaaaggagtaagaagtgaaagctcctggcctggagcacctgcaacatctgaaacaagaaatccttcattgaacaggatctgggcagcacaccagagtgatcacagtcagcagctataccagtgacaacagatgaatatcaactctgcctttagcccctagggtatgacacctggcctaccaaggctgtgcctaaactctttggactgattcagaatcaagcaagtcctagcctaaagagaggagtttaatgtcatgctacgctctagcccaatatttgctgacttgtaattcagtcattaaaaaaattctttttatcttcacatagttttagattgtcaaactgttaccgttctgtgtccagaaattaaaatctattctttctattctttttttttttttttttttttttttgtgacggagttttgctcttgatgcccaggctggagtgcgatggtgcaatcttgtctcactgcaacctccgcctcctgggttcaagcaattctcctgtctcagcctcctgagtagctgggattacaggcgcatgccaccatgctcagctaatttttgtgtttttagtagagatgaggtttcatcatattggtcaggcttgtcttgaattcccgacttgaggtgatccgccccgctcagcctcccaaagtgctgggattacaagtgaaatctattcttatattttattgtaacctcagaaaagaatgcttttttgaggactagagttctgtctcttttattgtcttctcctttctctttcccaaacctataactctattttgcttagcacacaatgaataatcagatgtcttaaattgtggcttacataattactagtataacttttttgcttttttttatttcattttaatctgttcatgaggactgttacccaggtatttaaaaaatctcactccattgttttaaggttagtggttccaaagggattttagagaccctgacccaataatagttatatttttctaagtggttctgaagcaatggtcacaagtaagaaactgcagttcaaaacacatcataggtttgttattttccaaattcttattaaagcattaatgcaaatggaattttcctactagtattctgctttctctaatccttgacaggactaattgctaaactataatatgatttattataattttatgtttatattaaaaatatagaatatgattgccctttgatgtcaaatactaaagatcctgctactattttagttgtgctggttcttttcttccttatctttcattcaccttttcaattcatctcataaacatttaatgaaaaacttattgtgtatcaagggttgtttattatatgatttgtaattcaaaaactttctttctctggtctgagaattttagaaacatgaaaagaaagagggagggagaccaactgagagtataaaaataaatctggcatttattaacagttaaccaatttcttttttctataataatttatctactaaactgtattttttaaattattgttttagtttttgttgcatatatttaaggtatacaacatgatgttttttataattactagagtgaaacaaattaacaaactcatctcctacatagttatcttttgcgtgtatgtgtgtggtaagagctccagaaatctactctattaacaaatttccaatatgcaatacaatattattaatgatagtctttctgctgtacgtcagattcctagacttattcatccttcataactgctactttgtaccatttgaactacgttttcacatcccctgtgaaaatgggaggggggccgtaccatttgcatggaatatctttttccatcacttaccttttactgtatgtatgtactcagatctaaactgagtttcttgtggaaaccatacagttggatcttcattctttacccattcagccattctgtatcttttttattgaggagtttagaccatttacaatttaagtaattattgatagggacagatttaagcttgccattttgtcaactgttttctatttgtttataattcttttttctcttgctctcttcttcagtgttttgttggatttttatgctgataggttttgatttcttcttttgtgtaacttctatatattttttctttgttgtcaccaaagggcttacataaaatattttagagttgtaactgtccaatttatgctgatagcaacttagcttcctttgcttataagaactctctgcttttacctcttctcccccattatatgctactaatatcccaatgtacatctgtttatattgtgtatgtagtaacataatttagttatagttgttttaatacttgtcttttagtttttatagtagaatgaacatatttacctaccactgttatagtaatacagtattctgtattattttttaccaatgtgttccctactctgctgctttctttttgtttcaattttaagagctatctttggcatttcttataaggcaaatctagataaactctctcaacttttgtttgtctgagaaattatttatcttgcctttatttttgaaggacaggattgctgggtatagccgtctttgttgttaggttttgtgttttttttttcttttttcagcacttggaatatatcattcaactcccttcaggcctgcaaggtttctgcagaaaaatcgtctgataatactacagagatttcattataagtagcaagtcacttctctcttgctgctttcaaaattctctttgtcttcaacttttaacaattataatgtgtcctggcgtgggtctctttggattcatcttacttggtgtcgtttgggcttcctggatctggatgtttattttcttcccgggactggaaaatattcaaccattatttctttgaatttttttctctctctcttctccttttgtatattccgtaatatgtatatgggttcacttgatgttattccaaaattcccttaagctatctttacttctcttcattcttttttctttttgcttctctgactggataatcatcaataatctgtttttgagttagctgatcttttcttctgtttgatttagtcttctcttgaataccttctgagtaaaaacaaacaaacaaactgtttttcctctgctttcacagttcaacagcaatcagtaaagaagccctttgtgacaaaatgtgtgtttagggaaggggtggtttccttcacacaacaagtaagcaatcagttctgcagtaaataccagtttggtgtcctctaattcaattccaacacttctactgagagatcctacagattgggggctcagtccccgagactgtcttcctcaaccaacttccaatgccaattgcaaaccccaggttattttgcctgtacttcttactgactggctataaactgaggttcccacaacccccttctgaggttcaattaatttgcaagagtggctcatggaacttggaaacacttgcttatgtttatgagtttattataaaggatattttaagggatacaaacaaacagccagaagaagagatgtctagggtaaggtcaggaagggtcatgagtacaggagcttctgtccttgtggagttggggtacacaacccttcggacatgtagatgagttcttgttcaccttcctgtaagccttcacatgtatagctgtctagaagctctctaaatcctgtactctttggccatttatggagacctcattggataggcatgattgacaatcatgtggaaatgtgattggacaaaaagagtattagctagtgctaacagactgaatggaaaacccagaaaggcctgtctgttcagattcttcctggtctctctctgcagcattctttcctccagggaatggggcaggaccttttttgaaatgaaaatcttatgacctacaatcagacaaagtaggtcagagaatttctttatggccagaggcaggggaagacttaagtgtatttttagtttctgttgcctgccttatggagaaaaaggaacaggtgaatagagggtaagagaaagtcatagagagatttctgttttttgaggcctgcttctaatgtctaaagcaccccagcattataataaaagactgtaataagagctaaggaagttatgagccaggaactgtggacaaagtaatatcacacccctctattttttttttttttttagtttacttactgtattatttatttccatgatttctgtttggtactttttaatattttctatctttttgttgaaatctcactttgttcatgcattgctcacataaactcagtgagcatctttatggctgttatttttaattctctgtgaaatcagttacctccatttcattagggtcagtttatagaggatttatctagttcttttgtttgaaatatattttcctatttctttattttccttgactacctagagctttctttaaattatatgaaatagccatctctcccagtcttgtcaaactggctttgtgtagcagaggtacctcaccaatcaacttgaccagagatttgtggtgcctcttttttttttttttttttttttttgagacagagtttcactcttgttgcctaggctggagtgcaatggtgccattcagctcaccccaacctccacgtcccgggttcaagtgattcccctgtcccctgtctcagcctcccgagtagctgggattacaggcatgcaccaacacgcccggctaattttgtattttttttagtagagatggggtttctccatgttggtcaggctggtgtcgagctcccgacctcaggtgatccgtctgcctcgacctcccaaagtgctgggattatagatgagagccaccgcgcccggcctggggtgcctcttaaacttttgtgcttattcaaaccaccagttttgttcttagtggccctcggtaggaatgtcccaagtcctaagttagtgaccaaggtagagaaacctgtccctcaagaagcagctagaaatattggggctctagatgagtggtccatcttcctctctcctcagggataagctgggagctggactttataccccactcactctgcagtccagatagaggatctgtgccaaatgcttgtgctctatttcagacaatgctctctttaaacatttactttgctctctcaaatggcaggtctcattagctgtcctggataagtgaattagctggaagcttggttatgtttctggagtgaggagctgcaggaagtgccctcatgcctgttcagactcccggagttctactaattgcctgctccatcagctccctgatgcaggctaattaatagcttaatccacggacagcagctaggaaagtcagaatattatgtatgcagtctaactccgtccagggagaaactgagagctgggtgtttttgcttgctcactcttcactgagcttggggaactagctgctggtagtgcacatgagctcatttaaaaccacttctttgttccttgtggtcttgggggacacataaatgccagtcccccatagctcccagagctaggtgatttcagagccagtctctcaggtgggagctgtaaaagttggggtgctcaatgtatggacaaactccttccaggagagattagatgcttgattttatcattggattgagctgggggagaaggcacaggaagtgcccacacactagtgcccacatacataccctttcaagctcccagaggtcttactaattacctgccccactggctcttagtccacttagtaatgctataaggaatacctgttgctgggtaatttatgaggaagagaggtttatttggttcatggttctgcaggctgtacaggaagcatgatgctagcatctgcttccagtgagggcttcaggctgtttccactcatggtagaaggttaaggggagttggcatgtagaaatcacatggcaagagatgaggcaagaaagaaagaggagaaggtgccaggctcttttcaacaatcggttctctcgtagaaactaagactgagaacttaaccactgccctgacaagggcaccaagccataaatgagagatcattcttatgacccagacacctcccacaaggtccacctcccacactggggatcaaatttcaacatgaagctttctggggccaaacaaactgcatcaaaatcgggctcccagttttagactatgtagaactttaatccttgggcagcagctgggaaagtgcaataaaacccctaccagagagaaactaggagttgggcaatatcgcctgttcactctgtactaagcctgagggaattggggtaggaagttcttgcacacctgtttaaaattgccaccttgttctctgtggtccagagataattgcaaatgctgagcctatctgcttccagagctaggtgaattggtgattatggtttggctctgtgtccccacccaaagattgatcatggggacggtttcttccaagcattctcatgatagtgagtgagctctcacaagagctgatgaagttttaaaggtgtttggcagttccccctttgctcactttccctctctcctgccaccatgtaagatttgccttgcttccccttcaccttccaccatgattataagtttcctgagccctccccagccatgtggaactgtgagtcaattaaacctctttcctttttaagttacccagtctcaggtagtttctttctagcagggtgaaaacagaataatataaggagcaagtccctcagggaggagctgtaaaagttgaggtgctatatgtgtggtcccaaccctttaacttctaagaaggtaaagctaggagttgggtttccttcctgattacaaagtgatgtgcctgggtggtgctattggtgtgaattaaccaatttcttaaacatcaactaggtgttccaaactgtgctaagggctagggaaaaggctttgttatccttattctgagagagcttatagtctgattaggaataagaaaactgacacaaaataacagcaaataacaaggcaacataatcagttgctacatgttatggtggtatataaatgatggtagaatttagaaaactgaaaggggacaggatagacaagagtggtcaggaaggctgcatggaagagaaggaacttgatttgggatagaagaaggggctgggatttgggaagacaaaacaaaagaagagggccattccagtatccaagtaatgacagatagaggcacagggcatgtattaacacgagaatagcagaagtttgatgttggttagaacttactaccaacttcttacagaactttcctctaagaattatgagtttgaaaacattcaacacctcaatctactttcaagatttcctggcaaagtgaaggaagcaaatacctttattattttacaactgaagttacctgttttgtcagttatgatctaggctgattctaactacctatgggcaacctagaacagtcaaaagagctaggaattcattcaaaagaccaaaatctgcattgtctggtagtgtgagcatgagcaaatcacttcatctccttgagccccagttttctcatctaggaatgaaaagtagagccttatctatctgaccaggttattatgctattaagttatataagtaaatgtgaaaattcttcttaaacaataaaacaatataaattttagttggtacttttgttaacatctacactagaccacgtttatataggtaatttaaaaataaaaaagaatggggaattcattcttatgtcatggatttatattttttttgtagtacaaagttaatcgctcagcagtgtttgttacatttcaagtagcaaccatcatattgccatgaaatttatttagtaacccctaactactttttttttaatgaaatagcatagaatgaaagtatagtgtatattgtactttttagggcagtagattatatcatttgtcataaagatgagtgtcgtttagtgacacacaaaggcataagtgacatacacactggtcaaaatgtaaaatatatttctttttgtggattgttgtcaaagaagattgaaagacactaattaataatatagtatttcaaatataaaatcctcagtcttcatattttgaaccctcaaattaaactaaccaaaaagataaatttcagagaaaagttattttatgtaaagaaagtgagattttgatgaaatgagacatgctaccacatattctttattttcttcttatgtctcttgctgaaacccaaattctgtcttcacttctgctgcccaagtatacaaagcaaagggattttttgtgtgtgtttccatcaaaagctacatgcctagaaactcattgtactctattttttctggtagctcttgagttgtttattttaactatcaatcaatattatataatttaaaaataaaaacttaatttgtgacaaagtaagttttcagtctgggttcaggaaagaaagggatggcatatgcaaaaatgatgtaaccaggaagaatgcaataatatgtctatgtacaagaggggtgatagaattaaggaaaccaaccaaagatggtgaagaacccagagctaagaaaagggtactagctcccaggcctgaaaggtcacagtgttctaggttccagaagtgacactgagcagtgggagaggagcaatattactagtgccatcatgggaaaccagtcttttcaggaaagagagaggcatggaggggacaggtgccaatggctgaacccaatgaagaccaagggttctgggcaatgtcatctgtaatggccaacttcctggggcacagagcagggaagacgagagtggaaaatgagtgtggagcaacaaatggggagtaaccagcaacctattatatgaatgatcatttttcatgtcagatggtggcatatagcttttctactcaaattcagtttccttcctctgtttgctaactggcctagaccaatcctgatctagcccatggtagtttactttggttcctagctgttgggtagccaaccagtggtgtcttcctgcaggaacttcttagaagggccaaagataaaggatgaagtgtcctcattgatttcatagacacaaccagttctagatcactggttcaaagagggtaataaattagtaaagtgggagaacacgaaattaggaagattcatttctgctttattgtgaactgggtcaatttttgctttcttaatattaatcttgaaaaagatatcctttgaaatctcaaaatccttttctgtaatttaaaaacaaccttaccatctgtgtcctctgtcatatggtacaatattcaagagggtgaaataatggtccagtgactaagaaaaaccttaaaggataaattggccttagtgactgtcactaaaatgtaaacatggctttaaaaagtaaatcaggaggcatgaaagggccttgacagctaaggctctcaggaagggtctagaaagacatgaagcacaattttataagtgtgatataggagttactcttctttttttattcatgtgtcatagaagggaaaggaaatttctaaaggagtaagaccagccagatatcacaagaatatacaggaatgtaaggatagcatgttcaagggcaacatgaggagtcaaagaaaatgtcctggatgccaagactagctgtgttcttgcagctgctggctcctccttggcaaacacaccattggcaatgaactgatctgatgtgaacccctctaagtccttgagactctctttttattgcaaagcttgccagcctctttacccagtacatgtactccactctaagaagaaaaaacaaaactaagtgactgctaagctcatggacaatgtttttgggtctctccagcagccagctagtggctgactaggtaaaatcatttatttttctcaagatgttgtgattctgggaatgcagggtttggctgccatgttagcctggattttctgagatgcatccctgcaagagattcactgggaaattagatgtgcaagagatttatctggggaaatgcctatgagggaaaatggagaaggagctgcagaaggctggaagagatgaccactgcagtacaggtctaatcccagtggaaaaaaaaaaaggagagaaggaatgagaaaagggaaagagagaaggagggaagaaaggaaagaggtagggagggagggaaagtcttagacatcagtgcagtgccaagaaagttttggcaaggctgatggggagtcttcaaaccaaagtcacttgaaagaggaatcccctcatcatccctctaggaatgggcctgccttggtgtccttgtcatgcaaagtcactggctgggtggatttcagagcatagcagctgagggcataggccagttacactctgccataggaggcttgagagatgcattttcatagctgccacatttgccactgaaaccttctgggagtgatgggttgtgctggaagaatttgaagatactatcttatgctccagataaagaaatgcattgatgaaggcccttcactattagatttatttttgtgtgtcccaactattatataaattcccctatcaaggaattttcagtgttttctccttgcccttagatatgtgatcttatatcccaggtttgctgagacattcctcttacagatagttctactggctcatgagtgtaatgtgtctaaatgtatggttggaaaaatgtggttattagatctaaattttaagtccaaatttccttagcctgaagtttagagtcttccacagtctagtcccaaccactttttccaaccttaattaccattgcactttatcctgtatttcaattcatttgaaatatttgctcctttctaaattactcttgcttacccaccactatctctttgttcatactgttctcttcaactaaggttaattaatcaacatgtatttattgcccccttcccatgggccaagccctgtgcttagaactgtatgttaggggacaaaacgcacatggtttctgtcttcttagagtttgaatttagtagaagaggaacagacaaatacacaggtcaatggacagtgcatgcttacaaatcatgtgacagtgtcaaaagtaaacaaagagggttccctgacagagaattagaggaaggttttattttagatagagctatcaggaaagaaatggcatttcagctggaacttgaatgataaagggaatgtagttactaaggacttaagtcctgcaggtaccagttccatcatcttcaagatattgccatgatcttcacaaaatctttactgactcatcattggactctcaaccaattttagccctgtgctatctgcatcttttatatcacagaaagtgttgaagttcatactatatactaaatgtgtttgtctccaatcagactataagattgtggaatgttagacccatgtgtgatgtatgcctttgtatcctatcagattatatgattttggaaggttagagctatgtctgtatccagcataatatttatctctgtatctgcatgatacttaggataatagtatgtggccacatccaacaaatacttgttgaatgaataaacagtattccactctctgcaaatttggtctttctgacatttgtctgaattatagaaggagaaggaggctttacataatagttgaaaattactgttcatgtaatacagagttctgaacttcaaccagaagcaagtctacagcagatgaaaacatttgtaatgagggaattagctgtggataactttcggataggatgttataagtttagcatttgtattaaaatccattattatatgcataattaagttttaggaagaaaatctggctgaatagtaaacaattactattttcaaacagttcttcagcagttagttaccactggcttctagaatttaactgttgttttttttaatatatcaaactagcatgtgggttgagacacaacatcacattacaaatgggtagtcccttcacttgtagatcaatcagtaataatatagatactgatttttacagtttgtaaaattattgtcatttctttctcttattatctgtattctcagaaacaaagagtataaacaaagagaaagggcatgatgtatttttgataggctaccatctcaaattttcatttcaatgtttatttggagaaacacttttatctaaaatggaccttttccattttacaattgcacttgctctcagaatgagaactgcaccttccaggagagatttcaatctgactccaaagccttgaccctcacaaacagtgttgtttgtaatggcccctggttagaaactctcagcctaacaagcatgcagcatagcccctgaagtctctcctcctatctgcataaattggggatgtagaactcctgcatatccagcctcacttactcataaaatgctgggaatcattccaaattgctcttccagaggagggtttgtttttaaaattatttcagatagagatgtttcaaattctacataaatgcataatattatttctgattgtgctttcttggtatttctcttcctgtaacacctacttagccattctccagggaccacttcaaggacttttgtaatccatatagctttcctaagctgttctaactttcagcaatcccaaccacatcactgaccgagtttgtaatgactcaccagacaatgtgttgggtcctctagtaatactttgttaattccaagttatccttgctgctgttgtttctccgtgtgtgtttctatctgcgctctccagttaagctgtaatcaacttaaccactgggctttgtcttatactctacttctcacaacccttgcctcttaaattggttaatgtatgtttgatgactaattgtacacataatagctacttgataaatgttcttaagaaagggacaaattaagtattttccctgataatcctctataccaggcatcgctgtggaaagctgcacagttgggaaagcgtcatttcaaaaacaggaaaaatcacctgtaaattatttcagggatttgactttgacattatgttgacataaaagaggcttaagaacagctattagaaaatagaaacagataaatgaatgagtgaatggcatacctaaatggcatgaaatgtgaaaatgatacaaaatgttaaggtaatccttttttcttctctaattaatctccactgggtatggggaatagggaacaactggggtattcgtaacaggcaaacattcctgattcttgccctactaaaggtagggacattaggagaaaggatcatctacttggaaaataaactggcattgctaagtctaaatgattgagtcaagtgcaaattttataggccaaatagaattttcacaagtccattgactgttgaaaactacttgtaccctggctcaaaggacattttcttgctgtctgtagtaagcggtctgtaaactgtgtttaggacctgaaccgaatgctggcctttcacttctcaaactatagcttagtaatcccagctcagaagtccctccatacacaatttagtaaaattaacatcagagcataaccatgctttgttccctccagaagtaaaatgtgaagtttcttcccattggaagtctatttattattagtttcagatgttgtgacaccgttttcatccaaatgttagagaacagaaagaagccttttttaaaagcgtaactttcattattcatctaggtttttttcagggtccttgagaaatgctaagattatgccttgtgtttgagaagtagaaaaggaaaaagggaggaaaaccacctagagaagtgcttctcaaactttaaggcacacatgaatcacctggggaccttgcagattctgattctgaaggtcagaggtggggcctgacatcctgcatttctaacgagcttccaggggatgctgatgctgctggcccacagaccatactacctagagcagcaagctttataggccatagaggacattttttttttttttttttttttttttttttttgcatggagcacagattactgctctactctaggttacaattccaaggaaataatgactaaagaaaaatactgctgtttcaacatttctgagtcatttagtaagaatggaaggttaacattagcaatttaacatttcaaatgtggtgggagtatttattgatgtactaatttgcattttgttcctgccaaatctttttactctgttggctccagggagtttgaaagtctaggacagaatttttcttcctaggtttgtttacatattgtggaaaagaagtgagcatctttggagttaaggagagttaagacccaaggagaagaaagaaaaagactatgaaagatttttaaaatgtttatccctgtgtaagatctccaaagcccctcccttgacccagtagtagcaaatggagccacagtgatggctgaaattgaatatcccactaacttggtaaaagttgggcaggctcccagtcagacttaaatcattttagagaagtacaataatgtggcattccttgcaccctggtgatatgcagaaaatacatacctgcttccgacgaaatttaaacatggactgttaacaagaatgtacccttaaagttttgtaaactctacagcaaagaaaaaaaaaactgctacagaaaaaataaggattttttttctagctttaccagcgacctatactttcatttcttcatgttactaattacagaaactttcagcagaaatgtatcactcttgggcatcagttagttctaaacattttagctcttaggagcctctgatgacatctgttctgttgttagttttgctccctgactagattgtaacttctaagctcaggaatcatgtctgcaactacttttctttagtcctaacctaaccaagagctaggcatttaggaaatgctcactataaatgtattgacaaatgattatgtataattagctcttcatcacaatatttttcatcatcaagaaatagatttaaaggagatattttcaaacagtatggatgtatcatccccttacctttatgtatgtgtctggttgtgaatagtcagcacatattatggttaaactcaagaaacaagggaggttattttctaagcctgcatcatagcagtagaaatttggaaaaaaacaaaaaacaaaaaaaaaaaaacatagaattaattgagttgtaatcaaagaaaattatgtgactataaattgtaatatttctaaaatatacccacatatgccaatctattgtaagaaaatgttcgcagagggaaaacaatggaaattcctagaagctttagatagattctaatgattggaaataagtattacaaatggtccacattttaatgtgacttctagaattttttagaagtcatagtatcctttcacgctcttatgctgcttgcttacaacatacacttgggtcacgtttttctgttaggaaatatcatactaatgatttgtgatcatatttaccacttggggatcttggtggccatgataaggaatttggactttattctgattacatgggaagccactagagaattttagccagtgaggtagcatgatcttacttatgccttaaaaaggttaattgttttggtagttaattgaaggaaggcaaaagtggaagtaggaagtctagttaggaaactatttgattgttcgggaaaaaggtgctggatgcatgggctataataatagcaaaggagatggagagaagtgaatggattgagatggaactgaaagaacttgttgatggttaaatgagttggaaggagttagagaaagcaaagtgacaaagatgactcagaagtgtttggcttaagtacctgagtggatggtgaaacaattttcagacatagagaagaatttaggaagaacagtttttttcagacattgctcgagagttctgtgttaggattgagatacctattagataccaactgaagatactgaagaggctgagtagagtctgaagttcaatggagaggctcagactaagatagaaatttggaaccatcaatgtgtagatgatatttaaagccatgagactcgatgagattccctttgcaggggaaaaaaaaaaaaaagctagaatattggagggaagagttttgtaacaggacaatatttatgggtcgggcagaggaaaagaagccagtaaaggagaccaagaaagaacagtcggtgagctagaagggacaccaagtggctcaggcatcctcaaagctaagcaaagagcatatttttaaaagacagtaatgtactgggtcaaatgcctctgagaagttaagtaatataagaaataagaagggactattgaatttgatatgaacaggtttagtggaatggaaggattagaagtaaaaccaaagtagattcagaagaggagaaattaggaagtagagacagccattcagacaaggacttaaaagatccaggaatggaaaggaaattcctgggagcgcaacccctaagaagccaaaaatagagtatgctttccatgtaggtttttaattcttttttggtggtgttctttagaaagagaaatgtctgttgggattattgtttgaaatggtgttgggggcccaaccatttctggcttctatagatcccctttttgtacatgctcattcccttaaaaaaaaaaaagaagaagaagactagattttctaatttagggcaaggggctaatagcaaaccaaactcatttgtaatctaaatggtcacatattattttggttgctcttcagtggcactagctgctgctaggaagttcattttacacacacacacacacacacacacacacacacacacacacagcatttgctgcagatcctaaacttgaagccctggatcttccttacatcatttacccagaagtatctttgtcaaccttcttaacttacatccaccagaaagtagaacaaggcagaagttgtgtgggagttctgttcctccccatttcccccctcacctgctggcgtcagcacaataaatactgtgttcagaacttggctaactgcttcttttcccacattcgatcagggaatacttaaagccatacagtgtccttgttctgccaaaaagcatatggggcaggttgccccttcaggctgacacaaagacacactgtgcaagacatctatggccagtggagtggccgtgtatgggttatcaatgagacttttgacttttttctttatgtcatattgtcatcacattaaatagaattcaaacaaggaaacaaaatttatattctagacttttaaggcattgcctgccctatagctatgaaacttttctttttcatacctggtataattttccactttaaacaatgttgtgtgatttgattaccgttttgactctcatttaattgtccattttaaaaattttaactgaagttagatttagatttaaagttcaatacccataaaggatacttctcaatagagccgagaacttcagaaggcacaacaaaaaaagggcaaagttcaaaaaactaagcatcaggtagctactttttactgcccagggacatgtctaggtaaactgtcaccatatccatctacatttgcttgctagtagagcttccattttctactgcaaaatagtttctggaaccacttccatgttggccaaaagagagtgtcaacaattcctttccaaaattgacctttagaaagtgaatctaaaatgtttgattcaagtatgtgaggggagctgcatcaaagttttcatttttactacatacaaaagtgacagataaatccgtaaaatgtatgcatttttctgctaagactgctaattaatttaaaaagagattgttagaataaaaggtcagagagtaaacatattacagatatttattgagagcctgctgtgtgcagagttggaaaaaataaaatgaggttgctcctttcaacagacttacaatctaattgagggagcgacagcataaatgtatgcaaagcaaataatgcaagatacagcataagacataattaactatcagatgagtgacatatataataaataccattaattcacaggcaatcgtaatcagaagcacttaacttactatgtgccaggcattctgctcagtacttcacatacattatttcatttttttgaaatattatttctactttatagatgggaattggctctgatcttccccctattctggagaaagcaaggataatggtgtaaggtagacaaagacccaagcagacatgttggtctggggcaaaggtccatttaagggaatggagagaaatgaaccctggggccagcattagtctgtttacaaccatatcccagtgcctagtatagtgccttgcacataataagtgctcaataatatgtcttgaaaaaacaaatggccctctggtctgtgcctgtaatccagatcaagtaccatggaataaagttaattagtgaattaaagccacataccacatagcttaaggacccatccccaagacctcccaattcccaactatgacaataaaggattgcagtggaaaagatacatcataaggggaatagcaatagcaattccagctcactggggtctatttcatggaatctgacatggtgaacagttcataagtttatttccaggctgcaagaccctgcaacatctggcctcttgcacctccacaacctcaaatccttctattcttctctcactctctctactcctgccacacatacctcccttctactcctcaaacccatttcagggcctatattcttgcttcatattgcctggaatgttcttccacaaaacatctgtgtggctcattaccataccttcagatctataacagccactctccccacatcttcccagctgcctgacattataatacacatctatttccttatgtgttcatccccgtacacactagaacatgggcccaggaaggcagaattccatctgctgtttttgccattgaatgcccagcaactaggacagtgcctggcacattgtaagtactcacacacagcaactctaactcaggattactttttctagctctgaaatacctacttccaagagaacgaaatttattcaagaaatgttggatggaaattgaagagtgagcttggaaacgagacacagagtggcaggagcccagaccaacctgtttatgaaagatgcctttgcccatagagggaaaaatacaccttaaaacctctgccaaagtatatgctttcttaggacacctctgacatgctgaattgcacctggtctgaacaagatctatgaatttgccaaaacaactaattcctgtgatttaagagtcactactaccagtatcagcctagtaaacaagtaccaagcaacgagcaccacatatgtcagtatccaaagacaaacatgctgctgcatgcaaaaccagacaaatgcattcacgcgggtgacagtgagtggaagaaattaatcttatttttattattttttcccttatcaaacactagcaagggactagatgtcataaatctagttaaaatatgttgactttgcctcaaatttgagcattcatggttccaaaaggacacttgttataggatctgatgatgtactttagaatcttcttttgtgcaaattgagacttcagagaactcaaaatatatggtaaattcaaagtaatattataagtaaaatcataatgcctcacaacattttttgaaagttaaatatttagtaattttacaaatatgtattgagcactccctatatttaaggaactatgctaatgctgtgatggatcaaaaggagaataagccatgatccttaccttcagacttcaagcttattattcattgggcagttagataactaacatatcagacatggaataataagtgccattgtccagatattaaaaacaaaattggtgttgtggaagcaaaaagaatgtagagatggatcccaactaggagaaagaaaaattgcttcctaaagaagacacagattgaccatgaaaggtggatggttctacacaggactagaaggtaggaattcttcatttgttggacttgctaattttttttggtgtaaatatacccactgttgttgatttaaagttgataacgtgatgcaactgaacacagaactgggaagagaaggtggctccagcacgctacctatgagtcaccagctgagctccagacttaattaaatcaacctcctcactactattttgaatgagtgaattcacaagtcttaaaaagatctatgataacattataagggaagagatagtcacttctgtcattctcccttacatctccatctcaccttccaatattctgtttgaatatccttccaatttcagtcatatgttcctggctggcctacctaggattaatattggcccagtgccaaaatgtgattctatttattccttttagcattgctgtgattaatctgcgctcctgttatcccatggcatagcaaactctcttactgattatggcctggtattgacacctctgctgttctccataacgaaaagcagcttttggggtggctagctgggcaggatgttttgctgctcttgtaacagtaggaaggaaaagctggaggaattactgggaagctttgcagaaggaagatacaggccagctgagagccagcattcatattgcctgttcctttcagtattctttgtgaaaacaccaccaccaatgtgttccctggacgtcactactgcacctttaactggccttattatgctagggactgcatttgaaaagccaaactctagtatctgtctgtaattgcaagcggatatctcagcacatgcacaagcttatgtcaggaggatgtttatgaaaaactcaccaagcagaacactgctagacaggaaataaatatgtgaagcttgaagttgttaggaaacttccacatttgtccctctaagccagagataggacctgtgagaaaagaaggtctttatcattgcgcattgattcttgctgaacccctgctattctcaaaatacatttacagcaaaatgtggctactgcagatgtatttaaacatgtgcttttttaaatgacactggtttatcttccaagtttgttatctactattttactgtaaagcattaaaaagtgtttgaaaccaccagcaccatttcacagttcctgttttatttgtttaaattctctagctcatgtaatatgctgtatgatttactgttcaagtagagaagaaatacactccctcatggagatgtggggaggtaatactgtctcttggaagggctcagagatttcctgtttagattacacaggcttctttagagctgccaagagtcataacatgtacgagataatacactttggttcaggaaaaactatggataggaatgtaattaattcactgagccacaaaagatattccagcttagaaatgtcactgcactcaggcctggtggactcagtatgccaaggggtagccatgaccaaaaagaggattgctgcctgaggacccactgagtagtatccaaccacagagcaaaaggagggggcctggctgctaaggacatcacacgtctcacctgcttctttgagaattgatccctgaagggtatttctgcccaaagcctcagcaacctggcttcatcaatataactttgtgatgcttgtgacattgagatcaatcaatcagcatgtactttatcaagtgcctcctcatgagtaccaattgtggcacatagtggggaaaccctagaggcagagccctgcagaggatatggtgattctgaccagagcaagaaggtatagtgaaaagtttcctaaatatattttgtgtcttgtcataagaatcacctggcagggaggggtatggaagggcaaggtaagcatacacattcccaggacctttccaaaatgtagagtgaccagggacttagagattcagactctatcaatctggggcagggccctagacttggtatatttaataactgctgtgtgaggccctttacatgcatgacctcctgtaattgtatagcttggttgctgtatatggtactatgtttacttgtgtttgcactgtctattcaggggtgtttctaaatgccattgctacacaactggtgaattatgattcttgccagaacattgattctcctactcttgcttccttaatgacacactagagaactgggattggctgcatttagtctcaggatgaatcattgccataagtagatttccatcccctactccaccaactcatttgccaaacacccttaaagaacagaacccactgcctacatgcagcctgcaccaggagggcctaaatggtctagctgggtttatgacaacatcccgtcttcacatcagcaaaaccctaagtgcacaaagtctaatgtaaacacaatgtcaagttctccataggaaaagacatgtccctgctgtcaaggtagtgactagcaataataataatgacaaaaacaataacaatgataagcatatataacacttacttatcactaattatattgtaaatgaaatgatttgcatgtactaactgatttaaatcttatatatatatagatacttttactctctcaattttaaacacagagaaaccaagacctagatacgtgtttctgttgagaagttgagtacaaggttgagtgtaagtagggaaagttcaactgcagtcagttctagtcttggtaagtacactgtgaggcgctccaccccaagcatagcaaattaatggttccccagtgtttgcagaatcaaaattaagttctttggctaggttctccctgatgtgcccctgcttcttccctaattcaacacatccccagctccatccatgcattcccaacacatcacagctctttacatgcccaggctgtgtcttctgcacctttgtaccttctgcacctttgtttccttggccccaactgccctttcttttcctccacattaccctttatcccaaatttagcacctgtctcaaggagtcaccttcccaaggaagtttctccaaatttgttaacagatattccattgttcctccaatgcttgaccactcttcctttatagatccctgcctagaaaaatgtgggctcactgaggccaggggctgcagctagtttattttataacccagcatttaaaagtgcctatttattgatttgttgggaatagttaataaatggagtccttgcagatcataaccaagaccacagttcgtaatggtttcattaactttgttactattggatgtgattctctgcttatggtcttcctttacttgtttttcccttactgctcagcacctctagacattaggtacatggctctgatgctaattaaaattgatgactgagaatgacacttccatttgctaagccagcgcagttttgttcattgtgctttactttttaaccagcacccttagcataaatctgtagtctttccatgagggtaccatttgttccttttatgtctcgattcattacatattttcaggactgttagctgactaagactttttgctttgtgaaaatgtcaccaaatgcacgataaaggcaaagtcacaagatgtctgtttgcaaaaagaattaaatgctggtttgtgaagattcaaggctggccagggctccccaagcatttccaggccagagctttggctctgcactctccttaggatctcataactgacccccacattccatttctgccatcgtggaaaaatttgtcaactttactgctgatgttaggcctggaaattgtcatccattagttttctcagattcaagctgaaaattgagacaaacttcctacgtaattttgaccaaaataacacatatgtttatgtgctatcccatgattaacatatttttaaaaccactttattgaggtatggttggcatacaaaaatctgtgcatatttaatgtatacagcttcatgaatttggagataagtatacatccatgaaattattactgcatgtatgccataaacctatcacctacaaaaatttcctttcactttgttattattttgattaacttaatttttttcttcctttgaactatcaaaactttctcaagtaatacatagttgtcagttatacaaacttactgaaccttgaccaaaggtcctcttttagtgctcatcttagagaaagaattaatgaaacaaagtgttctctgatttgtagcaaagatctgtgatggtggtgggaatggttctagaaaataatggtaataataaaaacttagagtatcaaagcagcaagtagatttgaaggaattgttacaatgcaattttgctttcccgccactttaaaatcaaggtgtagtactttatttactttaggaaaatgtttgctttttgtcataattccttattgcatatgagagtaaatgatctatagatgaagataataataaaatttagagagagaataaaaaagaaacactttcacagctgaaaggctgcttcccagttagctaactgggaggagttactgaaaaagtacattgaaaagcggctcaggggcaggtgaattggactcaccaggctctgacattcagagagatgggaatgagtcagctcactgtccagcacatctttattttatttctctttcttgttttatatcagaaatagatttcttggcattgttactgtgggtttctattaaggactgaaacaaaagtattaataatctgagagtatgtaaaaaaaaaattcattttctcctactatactctcataacacagaatattttggtgaccagagatcaccaaaatgtgtgtggtgtcaacgaaaagagtcaaactctctaaaatatttgaagagattttttctgagccaaatgtgagtgaacatggcctgtgacatagccctcaggaggtcctgagaacatgtgcccaaggtggtcagggtacagcttggttttatatattttagggaggcataagacatcaatcaaatacatttaagaaatacgttgatttggttcagaaaggcaggacaactcaaatggggggcttccaggctataggtaaatttaaacattttctggttgacaattagttgagtttgtctgaagacctgggattaatggaaaggactattcaggttaagatatgtttcttattggacctaaaactgtgcctggctcttagttgattactgcctggatctgggaaggaaggaaggaaaacaaagggggaaggggattctctatagaatgtggatttttcccataagagactttgtagggcaatttcaaggcatggcaaggaaatatactttggggctaatattttttccttgtctcataatgttatgccagagtcatattgaaaagcaagtcacaatatacaaggtcaaataaaacccatcctgatgagaacccatggtttgtagggcatgactccccagaacccttaggtaggaatttgggcaagataaaaaatcggaacttagtcctcggtgggaatctctccccacacaaattctccaacagattcttcagtgggacaccaactgggtgttctcaaattcaattcaattctgacaatctacctatctacctggaaatagcatcagataaccacaggtttacggctcattccaacaatactgtcccccacttcagatgccaactgcaagtaataggttgttacctatacttctagccagtcagctgtaaattggtgttcccacaacctccccctccggtttgataatttgagacagcttgcttacatgtaccagcttattagaaaggatattacaaaggacacagatgaagagatggatagggtaaggtatgtgggttggagttgcagagtttccatgacctctctgagtgcagcatcttcatgtgttcagctatccagaatctctcggattaagacattggccactggtgatcaaattaaccttgagtccctctccccttcctgaggttggagagtggggctgaagtgtctcaacctctaatcaactcttggtctttcctgtgaccatgccccatcctgaggctctccaggagcccccaggcatcagtcaactcattagcatacgaaagacacttatcactacagagattcgaaggattttaggaactgtgtcaagaaacggagacaaggtcaaatatgtatttcacaatatcaccagtagtttcactgggaggtaaaactcagtgtttactgtgggcctgagccatgctgaccctctaagaataacttagaggtaacgtgatcagatgtggggaattctggagaaacacctttcaccaccaagcccagacaagagatgcatacttttctagctgggatgcttacaaagcaacccactctaatacttcaaggtagagtgacactacattcatcatttttcattttttcctgttttttatgccatctactactaatgtcaatcaaattacgactgtgtttatagtggatgaattatggaccatctcacaccataaagttctgtttctctcatgttgagcttttcacctcccttcattccctccctacttccaggatcattcacatgtttatttctaaaaataaactttttttactgaactttttttcatactgtttaaaaagaatttatatttctcttcattcttacagataagattcaagtttaaactcaaataatgtaggaaatctttttttaaaaaattgttccctactgtgtctaggcgtgagaccaaaagtaattaagaccaggttttcatttgctgtgatttgtgtgagttctttttagaggttaggtgcaattttaatttttaaaagggggattattatgagaggagaaatcatactttatcatttgaaaatgatgccataacaggtgttagcagaaaaatcaaactgtaaaatattttaaagagatttattctgagccaatataagtgactgtggccccattgaaatgagcgagttccctgatccctctcacagagcttgcgacagggatgtggctcacctgttcagttgccccactgctcaaacccctagggggagaatacagacggtcaggtgcaaaggctggggcaagtgccttggccccttggccccttagccccgaggtagtgtctaggggtggggtgcctgcaaccccagtgttacaaagttctttcagctttgcagtccacggacagcttgagtgttaatcagctcaatggaccctctgccttatagcaaaggcagagggccagtgtgacagctttctgtatcccaagctcttgcccagtgtcctagaaaaaacagatcatacaggggctcgaaggatgagtgcaaggttttattgagtagtggaggtggctctcagcaagatggatggggagtgggaagtggggatggagtgggaaggtgaacttcctctgaagtcgggcagcccagtggctggactcttctccaacctcccccaggcaagctcctctcagcgtccagatgttcctcttccctctctctctctgccgcatcatttcaccatctgtctgctggtcagctggcttgctggtgtgctggtctgttggtctgctggtctgcttctggaacctcaggttcagagtttatatgagtgcacgatagggggtgttttgggccaaaaggtagctttttggacatgaaaacggaaatgcctgttcccatttagggctgcaggtcttcaggcttgagggtggggcctttgcccaggaactaccctcttctacccagtgtttccctgtctcctgtccatatcaccagtattcacagtctcaaggagtcttgagaaagtgtgcccaaggccgtcagattcagtttggttctgtatgtttcagggaggcaggaattacaggcaaagacataaatcagtacatggaaggtatacattggttcactctgaaaaggcaggatgtcttgaagtggggacttgcaggtcatagtttggttcagagattctttaatctgcagttggttaaaggaacaaaactgtacagaagcttcgagttagcaaaaagaaatatttaaattaagataaggatgctatgtcagagtcagccacaaaatgacctgtttagcaagattaatggcctataggtgtgacttaacccttgccttgcatggcctaaggtcttgtttataatttagtatcttattgcccaaagagtctatttagtcagtcttatgatctctactttaacattaatgctggtcacttgtgcctaaactccaaaggggaggtatatccaacctgccttcccattgtggccaggaacctttctctggagtccccttggccaagaaggggtccattcggttggtttgggaagctgaggattttgtttttagtttacacagggtcatatcagattgttttgatggggatgactaatggttttcttctctttctgtttcagccacagcagctatccttagcagagcaccctggagtctgcaaagtgttaatccaggcctaaagacaagtaagaatttcagtcctttttcttccttcaatgatattttccatgttttagtgtaattaagctactatcctttctctattttatttgggatggtagtaactggaatagtgactgagttgaaattttataggcaagcaaaacattttttaaggatttattttttaacttctgatatagtttggatgtttgtcccttccaaatctcatgtaatccccaatgttggaagtggagactgggaggagatgtttgggtcatgtgggcagattcctcatgaatggtttagcaccctcctctttgtgctgtcctcaccatgagtgagttctcatgagatctggttgtttaaaagtgtgtggcacctcccccttcaatctcttgctcccactctcgccctgtgagacacctgctccgcttcaccatgattataggcttcctgaggctttcaccagaagcagatgctaatacagcctgcagaactgtgagccatttaaatcatttttctttataaattacccagcctcaggtacttttttatagcaatgaaaacaaactaatacaacttctgtgcaaggctgcttttttttctattttttgcttgtgcttggaggttaagtaaggccaaattaatgaaggaggaaaaaagaggaaatgatacatcatggatcaacaattatttattgaatttaggaaactgcctctttttataaattctttttaaaattattttcattattatcttgaagtatttatctaaggtttacactggtagaaagttaaacttgtctctccaaccaaattgccttaagcttcaaaattatgccttattgtaagctctttcttaaccttaaaatgactttacacattccccgctggtcctttgacaatctcctcttcaaccacaagacagaaccccaccatcaactctgtggggaagcgtctccaaattctctagtcctgaacaacattctgccttctctgcttccatggaactttgtcctttacaacatgatagcgtttgcctcctgacattttagtgtgtgtgttagccctgcatatagaactcaccagattgtgtggactgcatgaatgaattaattctattgaactttaaggcaaagcctaaactttatgcttcttctaaatcccttacatctcctaaaaaaattctgatccatagtagtaggtacttgtttaattaaattttagggatggatatttttcatcagtggaagtatatgctagagtccatattatgcaataagggaagggaagacagtgtacctaaatcagttaagatattgctattcttgttgttattctagagtcacgaaatcataatttgaattttatgactaaattgcagaattaatttccaatgtgagattttaacattatttccttggaggtgaccaaaaaggagagctggtactgtttttaacaactgtcattcaattgtcagttgtgccagaccacaaatcctttatagccctcctgtttaagaagcatctgacatgttaagctgctccctaattaacacagaggttgtaaaagaagtggctgtttggttctgtttgggtttcccagccagtatattccaaagccttttttcactcaacagatgagttatgtgctttatattctgtaaggaaatgagaagtaatcagttgaaaatgtgttactaatggtacatgcttcacattgaaaccatcctcctgacacaaacataatactttgccctccactgtcccccaaagtggcagtaggatttctctaagtaattttctttacttatatgagtgcaggatagggggtgttttgggccaaaaggtagctttttggacatgaaaacggaaatgcctgttcccatttagggctgcaggtcttcaggcttgagggtggggcctttgcccaggaactaccctcttctacccagtgtttccctgtctcctgtccatatcaccagtattcacagtctcaaggagtcttgagaaagtgtgcccaaggccgtcagattcagtttggttctgtatgtcacagggtctaagaagcgtaaacattgtgtcttgttgaaatacagcctctaggtatggaggatgtgttgaacaacttcctaccagtcatttggcatatgttgatttcctgtcttcatgatacgtaagacgactagctaattatcattcatatgtggtaagtcacatagatactgacttcccctatctttccagctttttcttatcaaaagtcacctgctctctgtcccaggaacgactggctaaagtaacctatatcagtgtctgtaacagtgggcacctatcatagtgcacatgcttgaacatatcattgccttttatcatcacgagcctcacatccagatgtgacagactcaagtgctcacatcacctcactctgtcactgtatacattgttaccgtgtcacaaatatttaacagtctgctgtgtactcagtctttagctgtgtgccctgagggagacagagtaagatactgccttgacatcaaggagctcacattctccctaaagagataatttcacatgaaaagttagtgtttaatatgaaaagttagtgtttaacatgaaatgtcctgagaatatacaattataatttacacgtttcctgtgtgtacttttctaagttctcagactcaaaacaaagccccatggaagaaaaaatgaaataaaaaccctgtcaggacaaatcctagccagaactgaccaaacataaaaaataaatgccactgccctctccaagctacctttactttatacttgggtccaagaagcccaaacattgtgcctcattgaaatataacctctaggtatggaggatgtgttgaacaacttcctaccagtcagtgcagtgcagtgaccatttagcagcatctccctcctctctccttccaccccctgccccatctctccttccttgcatctatcttcccctgccaacaataattttcttatgttctaagtaaatatctttagtgctctccctactacctaaacattaaacttcaaacctttcccaagaccctgaacacccaccccagcttgtaagttcaggctacttaccattccccaggcacactgtattttccctcctctggtacactgctcatgtcatcgaatctatcttcctcccaccccatcctggattctgtaaatataaatcagtcctgcccacctttaagtttcagtcaaaacctgatactcatggcctgaagcaatccctcccttctccatgctggtctgagagaggtcatgatatttcagtagctctggagagacacatatggtcaaaccagaccagctaaaattaacccatgctatgcacaacctaaagaatcacctcttgctgtaacctctttcttctcttgctcaccaaaaactgtctgtcacatttgctaagtaagcccttagggctttgctgtgctggcaaaaggtcttaatccatgtgaatgtgcatttttgtgttagtgagcacatgctaacatgccttccacagattagtttcttaagaaacattttctgggggaaaaaagacctgtttttggttagtaaccccaaaaggacctttcagttcacatacgtggtagcagcatactccacttatgcaaaggtcagcccagggtaaatatgggcaaaaacacagacttaggataagaagaatgttaagggagtttacagtttaaagagatatccaaacaacttttttatattttaaagaagtaatgctataattttactacaaagaaaacttctttatatttctggggagaagaataggaagagttacaatctcctagagaaaagcaaaacatttttagtattcccaaataagacaggcacctcaactagggtgctgtggttgcacgttctttgtagtttttcaagaattttatttctctgtcatgattatttattggcagaagatttgttgggccaaacatgtaagactttcttaaacacatatagagaaaaaaattagatgattgcacatctttctgagggagatttttcccctatttttaaaagtcattgcttttcactgaatttgtcttgtattcctataaaagtgtaaattttgtgattgatagcatttttacctcaaaatgaaatgaatatccaactggagcaagttttattgactgcttattggagcataaattagtctaagttttcatgaaaataggcatttgaacatgagtattaatggctgagatcagaggcaagttttgaaaggattccaaaatattatcatattagataggcaagcaaatgaattgcttgaatgctagaagttcacaaacattcaaacaattgtgagttacattaacttcaataaaaacttttgcaggacaaaaatttaatatagtaaacttcatcttgcttgtccaggtccgtatacattcttagctggactcttgtcctagcttcctaatttttcttcctatctcctatttttccctattccaagccaccatactctgttcttgattaattcttcctgcctacctctgattcagtgattcatctgcccaatcatctatagtagctccaaactcttttctaaattatgaataaacttatctccctggcattcagaaaattcaacagcattcatcttacacacttttctagccttatctcccttttctcttatgtactcctatgtttatattccctgcagtcttgcttcattatatccatttacaatgacccttttaccagtaatttcctcttctttcctctcagtctgaaacaatccttcatagattttgtcctgtgagccatatttcaaatacaactttatccacaaagctttgcccagttcccacaagaggattctgcttttgctttagaattgtagcctttttttcctctctcgcaaggagagagagcgtagcaccgcagtttaagtactcagcctctggagtaagctttagtttaagacccagttctactgcttacttcctgtatgatcttctctaaattttatgatctctttgtcttttttttttcatctctaaaataaagatgctaatagtacctacctcataagatggttgtgagaattataagtgttgatatatttaaagtagttagaatagtatctggccctacagtaagcttacgtggtatttattgtattctcttatggctcttattttattccaatgtgtattaaattgaaccgtatgaaattgcccatgtcaactctatattggaccctaaaatcattatgtcttttggttcaaccaaatgtagtgctttttgcacccccccttaataaattgaactatctctaaagatagggacaatatcttacacatcattatatcctacagtacctgctacatacttgacatatgctgagtatttcacggatggttattgaattttgcacacacacacacacacacacactgcaaaaaataaacagaagccaagccctccccagtatcttaagtactctttggctaccagggagtttactccatgctgttcagcagtcatttatgaaaggagagtgataaagatatagaggaggagaattttatcttgtctattgctgagtataaatactatgcctttccgaaaagccttccacagaacctttccttcaggtcagggacctagtgtcatgggtcggtcttggataacgttgcaggacatatcagttcaactgccaagggaatcataaatagtcctactcctgcctgcggcccaccactgcctctctgctttcattcttttttatcagatattttcaacatcaagaacttattagctgataatttaactaaattaagtataacataagggaaatgtgtcctggcagagatggcatcttagagtgaatgcacagtctttattggttaccaaaaacaaaaaaaaaaaaacttgagctttggacaagcagtagagagcagatttgatactgggttctgacatggaagctgacattaaattattgacagtctacttgtttataaactattcaataaacaatttagtaagtaaacatagattcttgcaatcccttttaaggaaacagtgtttatgttggctctctcttgtacccaacctagtgctcagcctttcctgactcacataagcactaatctccagataacaccaagcaccctagggttattatttatcccccttccttgttctctgaaataagagaaaggcaggttaaattatgcactttatgtaagaagaaatggaggtacagagaaaacagcttaagtctcttaacagcccaagagagtgaagaagatattgccaatgcaatgagttgtatctgtccctaggtaagtaaaatattaattaaagcatacaactatattaataattaaaacaacagtctttacttatatggactttgcagtgacttttttccagcctgaaatactcagataatgactgccattagtttcacacgttagtgctttattatatactgctttgttttcacacaaaatcgttgagaggtaagaattttttgaaagaaatatttggtcttaacttttttatcccccttcaacttcaagcaattttctgagcaatgataagtggtaagtagatatttaccacttagtttacaagagacctgtttctctctgtgcattgacttaggcactattaatgaaacctttggaatgcaggtcccttctggttgtaaacatatactgaggtcttctatttcttttggaactcaaacaataagaaaatagttagaaatctgtttgtgggcataggtctctaaaagccttaatcttagaagtgagtaaaaaaaattttaggccagacgcggtggctcatgcctgtaatcccagcactttgggaggccgaggtgggcggatcacgaggtcaggagatggagaccatcatggctaacacagtgaaatcccgtctctactaaaaatacaaaaaattagccgggcgtggtggcgggcgcctgtagtcccagctacttgggaggctgaggcaggagaatggcgtgaacccgggaggcggagcttgcagtgagccgagatctcaccactggactccagcctgggcgacagagcgagaccccgtttcaaaaaaaaaaaaaaaaaaaaaaaattagagcctaagaaggatgattaagcatcttacttaaattttcagtatgcctatgtacactctatatactgacttctagcatggtttctttgccaaagcataacacacattttttaaagggataattcaagacaaacattctttcaccctgggtgaccccaatgggtggtgaacactttttagtaactcttgaaagttaaagcatccaacagttggttgtgacctttttggttgtgacctttgagttcttctagcttgtagcccactgatttgctgcttaattccacagcttcaaaaccaactctaatcactgctcccgagagagccctagcttctgcacacatgagtctctcaccaggaaaggatacctgaagtccagaaaagccctttgttcacactggctcctcctagtggggaacagtttttttaaataatgtacatttatgcactgggaaaatatcttgaatttattatttaggtgtaaccagactttaatacaacttaacctacacactgagaaagcagacatttacaaaaagatttatggctttgacaaagcgttcaaatgtagttaccattaaatagtagttcaagtaattgtgtgtctcatggcaaatacatgcaatataaggtaatatatatttaagccaaaaataacaagaggtgatcatttgctaaacaaagaacttattacttaggaaaaaatgttacacaactttcaaaggacttttgaaaatatagtatgatttataggaaatttatttgcatataattcacaatatctggtacaaggtaagctacctctgtgttttttttctttaggtcaacaaatatttaaaccaagggttggcaaacaggccctcagaccagatgcttgtttttgtaaataaagttttattggaccacacccatgcctgtttgtttcagattgtgtttactttagggctacagtggcagagtggagtagctaagacacagagcataggtccacaaacctaaaatatttactctctggccctctaaaaaaaagtatgccaaaccattctaaacagcaaagcaattaattcttttttttcaactcttattttagatttagggggtacacgtgcaggtttgttacatgggtcaattgcatgtctctgaggtttggtgtacaaataatccccttacccaggtattgagcatattacttgatgtttttcaactcacaccccgctcccaatcttcaccactctagtagtcccctgtgtctactgttgccatctttatacccatgtttatccagtgtttagctcctgcttataagtaagaacatatggtatttcgttttctgttcctgcgttaattcacttatgatgatgacttccacatacatccatgttgctgcaaaggacatgattttgttcttttttatggctgcatagcttttcatggtatacgtgtaccacattttctttatccagtccaccatcaatgcgcatctaggttgattttatgtttttgctgttatgaatagtcctgtgatgaatatatgagtgcgtgtgtcctttttgtagaatgatttatttttctttgggtatctacccagttatgggattgctaggttgaatggtagttctgttttaatttccttgagaaatctccacactgttttccacagtggctgaactaatttacattcccaccagcagctataatatggttgtttgtttgtttgtttgtttgagacggagtctcgctttgtcgcctgggctggagtgcagtggtgcgatttcggctcactgcactctccgcctcccaggttcaagcaatttgcctgcctcagcctcctgagtagctgggattacagtcgtgcaccaccacgcccggcaaattttttttatttttagtagagacgggatttcaccgtgttggtcaggctggtctcgaactcctgacctcgtgatctgcccccctcagcatcccaaatactatactgccccctcagtataatatagtattttaaggaactaatcatcaagtttgtactggttaccctcttttagtctcctgttatcttcaatttcataattggcattaatgacaatacagtgttcactttataaatttgcttcatagtaaactcttctgaaataaattacagtcatgcatcacttaacagtggggataggttctaagaaatgcataattaggtaatttcatcattgtgtaaacatgaagtgtactcacacaaacctggatggtacagtctgctgcacaccagcctttatgatatagtctattgttcctaggctacaaatctatacagcatgttactgtactgaatattctcagcaattgtaacacaatggtaagtatttatgtatctaaacatagaaaatgtacagtaaacatatagtattgtaatcgtatgggacgactatcatatatgcagtctgtcgttgaccaaaacatcattatacagcacaagactatagttgaaaattttaaattacatatgtgggttgcactgtatttctgtttgcagcattgatatatacatttaatggtttgtatgtttgtgcttgcattcataaatattaaactgttacagggagcatattttcttgtgtaaaaaaataaataatttttatttctaatgacatataaaattattatggttatgtttaaagaggcttgaagaggtattatggttatgtttgaagaggcaacggaaacgtcacctttgtcattgaccaaaacatcattgtgtggctcacgactgtaatagtgtaaagtaaggattcaatgtatcggctaatcaatgtggacatatcattcagtattattaaagatactccatccaatgaagactgaacacctgtaaatgcttggtgatggatggaaagggcaattatttgcagctggactgtctgagacgtgtcatcattattgcataatatttatttaatgaaggatcaatgcaccatacagctccagtttgagaacacacttgacattgtagtttgtagatcttttataaactaactgctatcactgaatttttgctgaagaataaagacaaaagattctctctttaggaaattgtgcactttaaagactcataaacctgaaacctcacagaatcataatagatgtattttcagagacaatttctgagtccttgacatattctcaaatgtcattcatgtcttcactgccgcaggttatctttttatttttatctgtcatggaaaagcagccttttttctttttttatctcctactatgccttaataaatagaatttaaaaccccgaatttgaattattgtgaaagccaatatttgtagcaaatccatctatgctctgtgttgtcagcacatatggttttgtgtacctgctaccatgaaactctgccagggttatcctcagagaaatggagagacacctgatgccatccttactctgacagaagtttttctttctgtgaattccaaaaacttttgaagttatgcatctcttgcattgaacttcagtggcttgtgtacacatggtatcttcctttctagattgtaagttctttgagggcagggactgaacctttctcatctttatatgctctgctcctccacccttggtttagccagggccttacaaaaagtagaagcttaaataatgtttattaggtgaatatcatactaagttccagaaattacctgagagcaattgaagaagggaagtgtggagggagaggtgttagcatagatttcatagtgtttgagtttggcagtttggcatccttttcctcaacactaatactgacacagataagtaacctaactgccttctcaaatctgagagcagtagatgcattttctcttttgggacttttctatctcatgtgggaaaagcaaacaagaaggtcctgcaaaagtcttgtgggtatttattcttatcagtggttgtggcaaactctcttactggtttcaattggtcccacaggctatgtgatgaggactttggggtttggggagctgggaaccatgagttgtctcttaagtatgacctaacatactgctaataccccacaagcttcaatttatccatctcgaaatggagatactaacatctatctcaaagggtcattgtgaggagcgagtaggaacatagaaaagttcctagcacaaagtagatatggaagatatggaataaggtgttaggtattttattatttttactgctgctgctgctgttactactactgctattattattactactcctggaagagtaggacttgcctgggacactgaccctacttaccccttcacctcattcaccaaaacttatctcctatataaattcatgtatatttttctggaaggataagaaaaatccttcatctaggtagcgtattttgtatttgaatagtttatgtttcaaatcccagagaaggcctatacagccaaatttggaaaaaaaataaatttaaaaataaatattcagtgtttcatatataataaaatacctaacatcttattccatatcatatatgtgtgtgtgtgtgtgtatcttttaattgccatgtatttctaccaaaaaatacaaaacttaattttgcgtcctgaaagaccctcgtttgagaatccctgcttttatgttctgctttagtccaggcaacagatagcttaggttgtcactttacaactggagcagcaggtagggctgagaggctcgccatactccaaattaccagtgccagtcccatggcaccaagacaggaaaggcaggcactcaaacagaaaggtagtgcaattaattgcttcaaattctttactcagggctgcccttagtcatgatcaaataaaatgtacacattgtttggcacttggtaaaatgttgtttcctttccttcctccttcccctgatagactctccttaggtacaaaaaagatgaggctgtacacagagctaaaagtgtacacctttgaaaaaggtgtctttttcaaagagcaccttcaccccttactggactaaactcaatccaaagctcttttctctaagctttataacacttactgcctggatgagtcatttgtcaataaatacagaatgtttgtataggtggggttcttgtatatatgtacgagcccctagagtctctaacttaaaatttatttttgctttagaagttcaggaataaggaggctttgatgatcaattttaacaaccgcaatatataatacagtaactaatggttaggtgtccaggctagcccagggcagcctgtgtgattcatgctgctggtgaaccatggctggctgggcgaactagatctggaattctgtggtgcctaagggagggaagggaatatttcccacactatctcatcctgccctcactatcgctacccccaatctctctctacattctaccccacctactttgctttttctgtgaaagaccagctggggcaaatattttggattaagtaaaatttgtcttgggtaacttccctaaaatttagtttttaattgaataatcttggttaatccatgagtaaataagcttgtagagtatagtcagcctcactgtgagaagctgacaaaccagaaaaccagaggaatatacaccaattccttcctgtcctgcaaacctctgcttcttgaggtttttaaagagtgggtgcctaattgattagtcattagttattgacaggaccaaagagatatgcctggctcctcttggaaaaaccaaaagactgagagggaaaagtacaccaaaaagatacctaaggaggcagactgctataaagaaaataattaggagaagaaatcatatgttttcagatgaaaagaatctgaggatgaaaaaagcagccttttcaggccgatgatggaaagatagaaactaaattcagaaggatcagaagacgattagaagggcaagaagtcatagaagaccaagatttcccaaattaccaaaagaaatcaagcccagtcttgttcaggctgcagaatgagaacgcccttctagtaagatccgtacaatgaatttcacaaatgttgatttctttctgtcctctttgagcccataatcacctccttctacttgcacaaccttgaccatcaccactacctataactaataaccagttcttatgttcccctcaaggcataacacaaaaatattttctttatgattactttctctacaaaaaagagggagagagagagaaacaagtcaggggacttcgttggtgagtgtagaccacagcaagaacctaaaatcctagtgggttgttagtatagacaggctgaaaccactatcctgaagtggtggttctaggtaggtatgcccatcagaatcatctgtggataagtattttcagtaaatacacatgcaggacctctacctcaaatgtactgaattgaacttcattgctggagcttaggcatttcatatttgtttcctaagctgctataacaaattaccacaaacttggtggcttaataagagaaatgtattctgtcacagttctggaggccagaagtccaaagtcaaggtatgaccaggattggttccttctggaggctctgaggaaattctgttccatgcctctctcctagattttggtgactgccagcaatctttggtgttctttgatttgcagaaacatcattccaatctctggttctgtcttcacttgaccttccctatgtctgcgattggtctcctttctgtctcttttaaggacacctatcactgaatgtagagcctatcctaatgcacaaggagctcaattataccttaattatatctgtaaagaccctttttccaactaaagtcatattcacaggtaccaaggtttaggacttgggcatatctttggaggatacagttcaacccattacacatatgcattgaagggaaaaattcacgccacaactgattatcctataaagaatgttggcttaacttaacgcatttaacgcaccatttctccagcacttaggaaatgctaggagatgcaaagctgaagctaaataggcttctttattgcagaacctctcagaggctctcatctgtttgtgtgcattataaatgtccaagagaaagaaaagaatcacaacatttcctggaaatacttgaccagggaacttcttttcaagggattacctgttaactacctcaatggacactaatgactaaaggaatacatgctgctggtgatcatggcacttccaaactatgctcaatggtgtgggcatgagtctaccacagtgtctaaacactaagattgttaatgtctacacgacctctccctggatatgagcacacatccttcatcaaatatccacagtggtttccctagaggatttgcatatgtgcatggatttttagatgtctagtctctactcttgtcttcagccatttttgtagagagaaattggcaaaatattagcatgaatggaagggaaaggtggccaagataatacattatgcctttttttttttccctgaaaacagcccagaatatctgaaaagggagaagtgacttaatcatttctattcccacaattctggtcctacaaaattgatatcagtatatgattcatccagagaagttcacagtggtatttttttaaaaaaaacttttagaggttaccagggcatctcactattttaaaatttaatacctcaagggaaataagcaactaccttgaatttttgcatgaattgcatttgagaataactgaatagttggtggaataaagttgtttttttaaaagtaggcatattctagttaataaatataaaagaaatggtaggattagaaaaatcactacattacaaactctaatgacataatagatttaagcaagatgatcagtgaatgataaaatatttaggtatgctgtcttctaggtgaatcaagctgacaataccttggacccacgttaatcttaccacatgatattatatgtctcctgatacttaaaataaatatcaaataaatcttgataattgttgaaaattgttgatgaacatatagttcacagcaccacccatgatgtattctttccatgagaattgatctgaatcaaagtaagcctctaggtctaactgccagtgtgtaggaaataccagggatagagaaacatttttaaagtctttaagattgcagtaagctgaaagaaattgtctggtttctgcaataacagcaacaaagttatgtaataagaagagagagggagaatcacggatttatacaaacttaagagacactgtgtgaatctagtttgtatcctgatcaaacaaattaactgtcaaaagatgtcttttgaaacatgatgggaaatttgagcataaactaagtattctacgatattcaggaatcattaccaatttgttagatatgatgttggtatgtttttttaaatgagaaagtttttagcttttagagatacatacctagatagttatgggtgaaagcatatcattaaaaaaaagatagtggaagtacacaaaacaggattgctatatgttgataattgttgaaccttggtgatgaacatataggaattaattaaaccatattttctatttttatgtttattttgcaaattccaaaataaaaatagaataatccctcatgaacagatggtctcaaatttcatcctcaagtaaacacaattcacattctcaggggaacccatgagaatattatgaagtatatgtctatctcatttcattatatatggaatcctaccattccttttgtctttattactagtggccagagttctatcttgaaaggtgggaaatgtccttatatgaacagattagtttagagaattattgtgagaaaaccagaaaatatttgagttctagctaactggatattgaatgagttgtgctgaagtatgtggtcataaagggttgataatgaaatacttgctttccagtggcaaggaaaaataaatgtcttagaatttacaaggtcattcttgaaatcaatcaacgtgggctgaagatctcattgcttctgttatctggcacgatggtatttgtttgtgcacagctctgttgatgtgagctatcaaatatttcttagagctgaaatcatctaatagcaaacattgctatgtcccaatggagattccaagactctttggccatggaacatttacattctatcccctttcatcactcctgaacaaacaaaaacaaaaaaaggaaagataaccaataggctttttatttaattgaaaaccaaagagagagagaggaaagaaccagttagttgccattttctaaatgcaggcttttgtttgtttctgccttctaattctttgctcttgaagctatagctttcaagcttgtgtatacaggcccagagagaacatttgaaatgtggccaccctacccatgtccatgccactcttcctgcctttctctctgcctacttctgctccaccatcccaggtcaggggcttggaggctgacagcattacaagtaatatagtcgttcaagctcatataaacaagatgaaatccaaataataaccaaaatgtattttatttcaaggactggactactcagttccctcagtttcgctgaccgatttctaggagccctaggctcagctcttggttgtctcagaactgaggagagtactcatttgcaccatatgcatctgcttgttagcctgtgctaccaaaattgattcattacttggccttctctgaaaagaaaaatgaaaacaaaaatgcactcttaaaaataattattaaaatacaaccaggaggtatgtgcctagacatggctcaccttctaccaaatcatactttatgattttccacaatattatcttctattcctcctgcccctaaggttccatggagcagagcaagttgaagaatgttaaggttttactaaacttttagaacagaggctttggggaagcaagagagaggtacactgaaaatgaagtgtctgtctctgcttctattaatgtcataggactagaagttgacctcatagctgattacaaatgaaccctgcaaattgaaccccagcacatgcctctcattatccattcttctctttgcaggatggggtccatgctcacatatcaagaaaatggtgggtttcagtctggctcactgggtgaggttttggcatgaaaactaatacgggttagtgtacatcacccataataaaagtaaaagcttttttttttatttacccaggtaaataagcaaaaggcagatctaaaatacattagagttaagttccatggggacagaaatgtctgctttgtttgttgttatacaattgacacctagaatggtggctggaccatagtgactacaaataaaatatttcttaagggaatgaatggttctgcaggatagatgttctctgcatttggataagtgatgatactatagactcagagcctagatagaaaatattgtcccactttcagttctgcaaactgacttgaggtgcttggtgacgtcctgcagcaagcaaaccaaatgaaggcatctctgagaccccatagtcaccaccagcatgctagcctcccattaccttgcccaccctagattttcaaattgggaatcactgtggtaccagactgggaatcgtgacttgcatactttctcatattggggcttgggattttgagatcttatttccttttttggcttcttgagatctgaaattgttgttcagagaaggatattaagacaatgactcttccattaccatgcatttctgttaccaacagaggaggtaagtgaatcacttaaaatgatacaattccatccacttcagtacaccataaacatatccttagctttgactataattatagtatgtgggtgatgccgctgagaaaatggtataattataacattatggttgagaattgtctgagtagaaaacactgagctgtactgtgcaaagtttaaggcggaattgtgggtcccttttcaatatgaataaaattgattagccaattgcaactgagagctttgtgcaatgatattaataatataaaaatcggccgggcgttgtggctcacacctgtaatcccagcactttgggaggccgaggcgggtggatcacgagatcaggaaatcgagaccatcctggctaacacagtgaaaccccttctctaataaaaataaaaaaatatagctgggcgtggtggcaggtgcctgtagtcccagctactctggaggctgaggcaggaaaatggcatgaacccgggaggcagagcttgcagtgagctgagatcctgccactgcactccagcctgggcgacagagcaagactgcgtctccaaaaaaaaaaaaaaaagtcaagggccaaagtaacaatgtaggaaaaatttgatgactttaatttcatttacttctaggagtcttacatgcaagcctaatgcagagtagagaagctcaccaacttgaaggaagcatgaatgaaattacaaggaaatctagcttagaaaaattaaccctgtagcttggtttttccactctttgctcttggcaaaaggatcttacgtatgtataccaaatgtctatttgaaaattttgtttctctgaatatagctttcttttctctttaacacactggtccagtggttctagattttatgctcccataaattaagtaagacagcattctatatcatgactgaggtgttaatgacattatgcagttgtcacattttgaaatataaacttaaatgcgagcttttcactgtgtgtaaagtttctctgtatttttttaaaaaatttttaaagaccagagattttcagcaacaagaaacataaagaagtaaaaagagcgtagaaaccctgccctagaggacctgctccaccacttaaaagccatgtacctcttgaagcctgtttcctttatttccaacacaggaatttttatatttacaccctaaccatcacatgggtcacatgtgataacaatgtgcaagtttcttacaagtgttctaggaatctgtaagtcttagagttctgaggtttattcccaaaggacaggaaattgtgggttacaccaaacagttaaacagggtggcagggaatccctgtcacgtacccaggcctttgggttattttctagggtgaggggacatggccagtagtacaaagagcatgtgaacgcatggatgtgggtgtgtgaggtcatgagtgggtgtgtatgtttatgtacaacacatgtattggaggataaaagggaaaataatttgtcttcctgacttcttctctattcctggcttttcttagattgttattcctctctaaacaaagcttcaaaacagaaacccctccccttctttattatatcggaaatctgggaattcagttatccttgtcttatcctactccctgttctgttctaaatatataataacaataagtaatagtactactactagtactagtagtagtagtagtagtagtggtggtggtagtaatggtagtaatagtaagaggatgaaaagatggaggaggtgaattggaaatagggaggtttcctgtagctgactgacagtttatatagcaaccgcctgcagatttaggttttttctgactgcgcttattttatagcaacctcaacaagctgtgacaacctgcaatatctttagcccttaagatactgtctcttaaacctgaccaatatttcttatttctcaaagagtaatgatagtcttttctgtctgataagttcaaaaggcacaactgattttcctaacattttcctcaaatgaagggagtatttgaaaaatggaactcaaatgaggagccacctcagaagcctaactggagcattcagactgcatcagacagacttggcttcagttctgacactgatacttactagctgtgggatttttggacaagcttctcatctgtaaacaagtataaatactacctactttataagctcgtatgaaaattcccacaaagtttgatgttagtttcctttctttttgtgctcagctctaaaaatatgcagtgtagtgagtcactaatatttcattaacataagggaaaactatatacccaacccaaaagctgagattcttcagaacattttttaaagaggttctaattaggaattttataaatggaatacagagtactttttaaataataataacaatgattaatttaagttactaaacaaaataccttaatgaatttgagaaaaataaactgaagataaatattaattattaaaagagaaaattattaaagtaataacatgcaagtcacttgatacttgcaaagtaacacagaattagacataaagccacatttaagaggcagcaaagccaaaatggctggccccctttaaaaggctcttggcaacagacatatggaaaactgtcatctcttccctgggcctttcttcctactctggataagcagcatccttcacacaaaagaacatccaggataactaagaaagagatgaaatgatttatcggaactagttaaaataattaaatcttaaaagcatgttctcctgggcatagagtggggtgatttctgcaaacattttgaaaataaagtacccctaaaacaaggatttggtttaactgctagaaaacaaggtgacaggttgagaaaactgaaaattttcttaaaatcttgtttacttgaatggtgagccagccacccagggaagaaaccagagctctttcctttaagaaatatagacttcagttggaagaaaaaattagtaggttttaaccttcaaccttctagtgaagtgagaatattgattgagcacctattattagaataaatttatcttaagtgacccagggaagggtcgtgggtgacgggaactgtcaagaaagaaaaaaaatatggctgtggatcttaagtacttaaaatctactgagggctcttgtctccattttccttagaccgtgatgttgctcaaagtcacataagagggcacataaatttactgaatagtattacagaaagcagcagtgacactgaaatgcttgcattatattcactatcccagtcatctgcagttgcctgagggatttgcaagcaaggacaggaaaatgctagtaccaaccagttctagataaagaatttatttgctccaaaaactttcactgtattaaattaaattagattggctggaattaaaaggtaataaggcccattttcttatgtaggtcatcaattaatttaactctaaagataattccaaaagaagaggtttaaaaattgtttgagtagtagtaacatcattggaatttatgtaaaacttcccaatgtactcacttttacagataacatatatatatatatatatatatatgtatgtctatgactgctggcataatgatcaaaatgatcagttttattactttgtaatcacatcaggcggcactgatggttgaaataaaatgtgttagatgagtgaatgcaaagataacatatagcaaatgaaagtctttgtctatgaagcacatgattgttataattgttgctgcccttttgggatcctgaaccagattccccaaataagtaggtaacacagaatttgtcttgagcactttttcaagcattgtaatccatgcattgaagtaggctttatcagcctacagctataaactccaaggtgattttaaagtctgaaggtttataggtcttcattaggataagctgggcttaccatataaatctatgaggactttgctagaaaaatagtggaattgttgaatagggaaaagagataatggtaacgggatttgcctgatgtcttcatcctagaaaaaaagatttctgcttgggcattaaggaccccagtgatgattctgggagactttcaggaatgctgacaaggctggagctactcaggatttgatgccaaagaagccacactgcacatgtgttcctctaaggtgtacttggttctcatctgagaggcaaaggctctacttctttttaattgtttggtcctaagttaccttcaaactccacctaaccacatctctaatcctgtgtatagcctttccaacatcttgtaaattccaaggggttgggggaacctttaggttccaaggctgagctaagttataaatgaataccctgtgcagtgttgagaatgaaacagaagctttggtgcgtggtagcccactgtgagtggggtttcaaaggagcagtccaggggccctacatgaataggcatatatgggccaagagacaggcttctctcagccataccatagtatactggaacaatgagaaatgggagaggacatacttcttaaagtgacacactgacctgttttcattctctcctctctctgcttctccatttccacttattgcccctattgcatctgtccagtaactgtttctttaacagttttccaaactgacattattaatccagaagatggatggtggttttttaattaaaagagaaagctgattttatttggtgagacttctgctatcatcttcagtgttatatcccaatatgagtactttttttaatgttctactaaatccaatagtatattcacctcactctcgagttaaactcttggctttaaaaaaattagccagaaaaacttcttaagaaaaaatacagtattttaaattctataaatgaactatatcttaaaatatttgggggcataattcaattgtatccattttactttaagatcatgcaaaaagggaaaggtatagatgctattttattgatatgctgctccatggatttcaaattcaacatcataagccaagatttgtgggaccagaggaatgttcaaaagtataatctgatacattatctgctgcaggaattaagtaaaatattgcatacatctcacttcctataccaaatagagagaatgaaagtactagattttgtattacagatagtttagacaactatagggaattctgaactttcaaacttttatatcctaaactcaagatttgggccttgaaaaataaaactgataaaactgctacagtgtagatttttaaaattacattcatgtggtgaagttgacactttctgttggtatggctagaagtcagatagatgcttaatttgaaagaccatgtttttatttcttctctttttcttaccctatgatttcattgacctgaagtggcttttagtgccattcaattcacacagaagccaaaattggttactgtgttaagaagaaaccaagatgttttatttagtttatgaaacactagcaaaattactatttgatgcaaaactgtgaggaagttttgtagtcattgaaaggagcaagaatatagactgcttgcagttccagtgtcgagacattcattatcagatttaccacttgaaaatattatcaagatagtatttatattgtgtttaccaggtaaactaagcactttagttctgagcactttacatattttaaatcattaatagtgctgtaacaagcctctgaggtaggtactgttatccctctttaacagataaagagactgaggcacaaggaagagaagtgacttgctgaaatcacacacagctgaatgtggaccctgattcaaatccacacatcctgactcaagcatccttgctctgtactactgtgctacagtgcctctttacatcctcctgatgtagaaatcttcttctagaataatgagaagcagtgtgaactttgaagtaggacttcctgggcatggtgctttccatctctgggccaaagttttctcatctttacaaaaggattacgatcaacccccatctcatactgtggttaggagaattgagcaagaccatatactaaaagatgtcagaacagggcctgacagatcatagtgcccaataaacattggctcttgttatcatcataaatatgttaaaatgagctttagtatgtggataatagtagcagaatttcctgaatgagacatgttaaacatttattaagcaggcactttttggagtttatcttataataattcagtaaggttactcttgtcatccctatttcactgaatttgaggaatctcaggctgcaagataacgtattagttttctagaatcaaataagcaaggattcaaactcaggatatattgaccccaaaacctcagatctttctgccatccctatcttgttctaaaccccaggtttgctcatccgggccctagtcattgatcaaaaagcaccaatacaaatcagagtagagaaagtcatattgagcttgtgaggttgtattatgggcatggtaacaaatgtaattcagctgtattggcacagtgcataacaaccacacttaatttctgtcctaagacctgtctgagcccataaataaagttacattaataattacggaatggtaagggaccactcagaaaatcttggttgatataggaagtggcatctgtggcttctaattgagagatattgcttcttgaatcagtgctagaccattgctctagggggatattaagccttctctgtccatggaagatgtgaaattcaacagctgacctgactgcttgtcgctgttgatgatcctataaaatttcctctaagatacgaactctgtgttctagtccaaatcaagtgaatatttcctgttggttgacctacaacttcaagggtatgaggtcataagtttaaaaagattccttttctccccagtgttgtaagagttattttagttctatcaaatgctcccagtgagtactgcatatttcctttttgccagatacattagctattcactcttttttcctatctcttctatgcttttattttttccctcatctgtttaaccaatggtaccctgaattttagaaccagacaggtagtaggacaaggcaggtgaaaatgcacaggttgtaaatttcagaatgcacattcaaattccatcgttgtctcttactaactgaatgaatgtaggtaagatgctttacctctcagagtcttacttaccccatctataaaatgagaataatacaaactgtcttctgtggttttcttgagcattaaacgtctctatttatggaacatagtttcacatagtaactgattctgtaccaatgccctgccccccatgtaggcaaatgcatgtcccgaaagacccaaaacaagttgtccctcttttcaagatgaagatttgtaatctctccttaaacttatccagttctggtgtttaatttcctttataagccagaagttgttttacgtctcaccaaatcttataacatgaatattacactgtcttccaaatgtgagcctctaattaccttaggccaatagcagagcctctgatcttgtcttttctccttttccgcttaccagacagcacattctgcctgagagttgagacccaaaaagatataaatcaactagggggcaaaaatggagtttcctaagcttgtcccagagtttgactcagtagcctgaggtggagttcaggggcttgatgttaaaaacaagctaccccagtggttttgctgcaggtggaccagactcccaagaccacattttgcaagcactggcatttaggaagagcacgtacctactctagcagagtttatgcagactatgattgcagcctagtttgtgcagactattgattgcagccacttggcaaggctctataagaaaaagcgagccaacatgtaagtaaattatcatggccttgaaactcctcatctgaaagggtttcctctcatcccctcatccccttgtgtctgcccctgaatgccagactatcttctccagccccaagtcaacctctcatttttaagccattcctcattctcctatatagtccaaaatagcgaatacatttttaggaattctcttgctttatggacgttcatccaaaaatatttcattatgagaataagtgcttagcttatcctgtagtgtctttctgctctaatatttgggcccttcctttccacatagttgcattttctttgacgggcagatgctgctcctttaatatttttcacacctttgtgcttctaacagagcaattatttcaggatgagggcacttggagagctgtaagaggataaggagcccagggctctgccttggatttgtgtacctaaatgttacctaattagataaacctgaggaagatgtggaagcaaagtagaatggaacagaaagtgtttgaataataagaatttggacattgctgctccgtggtgacattggcagactctaagcctcttgcctcattttattcattcatgtatgacggggttatgctcagtcataagtcactaaaatttgtattctacatcccattagtaaagtaatttttgaacacatgatacatatgtttacatatttgtaagttatatatatgtacaaggttctaatatattctgttcattgtcaaacataaaatatatataaatttggtttaatataaaatataaaattggcattagtagacactgtctaccgaaatgagacactgtctcatttctgaaaaaagcacaatgtatactaagttaaaggttcattcttaacagcagtaggagtagatctttatttcaaatagtctttgggataatttcctattttggaagacagcttatcagatttggttagagttgatgaaagcttattctagggttaagaaaagtattagcccagccattttcttattgttgatttgggcttgcataattagttttaccttcagtatgaagtttctttacatgaatctttttaactcacttatttgttatacaattattagttaaatcaattttaaatcagtataatctatccacaaaatcagtcatacagaacctgcaaaaaacatgttctaacatgttacatgaagaggtaactaaagatactacaaacaacccctctgaacggtaacactcccactcttcctgcaaaattcctctcatagcaaatgcaacatgtgactcagacacaggctgactgaaggctttatgcaactcttacatgctcaatattagaaaactttcatttgtttcctattttatataaacaacacatataaataaacattttagtatcttctcattacccagtggattgtcttgcatggtccattttgaagacagtaaactgtagcctctatttttatttaatttcaaatacctgtttgccaatattcacagccagctcttgttaatgttcttttctgtcctgtgaatcctgatgtcgtatcttgcaacatcacctctaaagcctatctttgcactcctgtccatcccccattctctattattatgctgcctctgatggccagagaaaaaaatcttgaaaatatatattgtattgccctacctggcgaggaatcagcagttatacaattcaaagttgcagcaattcaccacattgtttagcaccctactatgtgtaaggaggaagcttgatttaaaaaatatatacaatcatgccttcttcaagaatgttttggagcatgcaagagcttaatgctcatggacatttactttattccagcaaatttagacccaatctctgtgtagtttcattttgttttccatttcctgattaactgactatatatctagctacttatttgctgccatctagtgtaataaagtatgttgattatacaaggaattttgagcccattatgtagttgaatatcagtactcaaaatgattctttttttctggtttcttataagtttacaaaatgcctagtcagggacctttcttatcactgtaaccctgaacatggtcttaatcttgtgtcatagaatctagggctcaggatcaaccttcgttcattttctataaatgtgacatttggaaactgggtaggggcttagcagttggtggatatgaagtaaatatataagagtaatcattaagagatcatctcagtttagtgaccatgattttttcctcatggaggcagcaaaacacagcatggattcttaccagtagtgtgaccatgggcaatttatttctctcttggaggcatcattttcttcatatctaaaatgaaatggtaggtccaggtgactgttaaggtctcttctagctctaagagtctgtgtctacatataaatgattttctctgccaaagtagtgtttttagagtcctttttaatgccagaaatgaatacggcttctctagttcttctaagtggccatctatcctttggtgatggttagaagtaagcagagatcctggctagaaagagagagaggaaaatgtggaccatgattttattccttttattcttgagagttgtccaatgggatattgtccactagtggataagtagatacttgccaatatgcacctgacctcttctcttcactcataatgggaatttagaagtataatacctgttataatcaacttcctaatctctatcccttttttgtcactctatttcctactgtaacttctctatgaagtactataagtctacagtaacatactggtgtttccctttccttatgaagttttatatagctactccagtatatcctaaaatgttcctttttcttgcttttatagtggagtcttgcttgttggccaggctggcctcaaactcctgagctcaagtgatcctcccacctaatagtagctgggtattcttctgagtaggtggtcctaaaatgttttattttcagcttatttcataggtataagtcttattttcccaaccaggctgaaaacttttcagaatcaggacttgtctttagtttctcattttttatgaggggatgtggcattattgcttagggaattcagatatttctgataataaagatgcttttctgtttgttcatataaattagggtaaaagaggaagtacaaaactatctcaaatcaagtacaggactcttaattattactagctatctaacagctcatagaaaccgataagtttctgaacctaatgccaaaaaaaagcaaccttaccataaaaagaaaatccaaataaaactgaaagaggcagtgggcagtgctacctatgggaagaaaactttgaagtgggaaaaatctggattcacatcccagctttgctacttattacctttgtgttttggctaaaaattatctaactttcctgaagttaagtttccttctctgtaaaatgagggttataataatatatacagcatactccacagaagagttgtgaagatggaatgagaaagcaaatggcaaaaacttagcacaaagtaggagctcaatcaatcatggttaaaaagaacttttatccattgttatttttgcttatatacagtaagaattatccaatgcaaatgtaatcagagcatctgcaattgagctttataaagtgaattataattctcataccatagtggttctcatcaagggtgatttttttccccccaggggacatttggcaatgtctagagacattttacttgtcacactggaaaagagggggtgctactggcatctagtaggtagagagtaggaatgatgataagcattctctaatgcacaggacagcattccacagcaacaaatgatctgatccaaaataccaatagtgtggaagttgagaaaccctaccataaagcctagggagtccattacttctgacctaaatttgttttatatttaagagtggatgtggattaaaagtagcttccattttggtaggttatgaagagagttgtctaatctgtgctttagattctaattttgaggcatatttttaggctaaggcattgcaatatataaggctttctaagtttcagacattttcttggaggtcaacaaatgaaggcttggggatctattaacccactagagtagtgtaataatggtggtggttgtttattgaagactaaccaagtgccaagtactctataataatctgatttatttttcagcaactgtataagcaggtattttgctctcattttacacaggggaaaactggagcttagagaacttatgtaacattactagcaagttgcacagctgggattcaaactgaaatccagctagcttcaaagactgtgttctttctgctgctgcatactacccctacctaccaaggctctgagattagaaagcaggatgggtgtgttttaaaggaaataaggtaggaaagttttcaaatattagaaactctgcacaagaagattaggtcaagtttcccactgaggggcccttgagtatctatgaactcgatgaaaactctgagcttctcaggaaggtagaccaaagggaaaggattcatcaaaatggatgttagcactatgccatgtgtattactccatcctcacacggccaaaaggacatacctgagactgggtaatttgtaaggaaaaagaggtttaaaaaagttctcttcgatggccaaataggaacagctccggtctacagctcccagcgtgagcgacacagaagacgggtgatttctgcatttccatctgagctactgcattcatctcactagggagtgccagacagtgggcccgggacagtgggtgcagcacactttgcaggagccgaagcagggtgaggcattgcctcactcaggaagcgcaaggggacagggagttccctttccgagtcaaagaaaggggtgacagatggcacctggaaaatcgggtcactcccaccctaatactgcgcttttctgacgggcttaaaaaacggcgcaccaggagattatatcccgcacctggctcggagggtcctacgcccacggagtctcgctgattgctagcacagcagtctgagatcaaactgcaaggtggcagcaaggctgggggaggggcgccaggcattgcccaggtttgcttaggtaaacaaagcaggcgggaatctcgaactgggtggagcccacaacagctcaaggaggcctgcctgcctctgtagactccacctctgggggcagggtacagacaaacaaaaagacagcagtaacctctgcagacttaaatgtccctgtctgacagctttgaagagagcagtggttctcccagcatgcagctggagatctgagaacaggcagactgcctcctcaagtgggtccctgacccctgacccctgagcagcctaactgggagacacccctcagtaggggcagactgacacctcacacggccaggtactcctctgagacaaaacttccagaggaacgatcaggcagcagcattcaaggttcatgaaaatccgctgttctgcagccaccgctgctggtacccaggaaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctgaaaagcagagcacctctcctcctccaaaggaacgcagttcctcaccagcaacggaacaaagctggacggagaatgactttgacgagctgagagaagacttcagacgatcaaattactccgagctacaggaggaaattgaaaccaaaggcaaagaagttgaaaactctgaaaaaaatttagaagaatgtataactagaataaccaatacagagaagtgcttaaaggagctgatggagctgaaaaccaaggctcaagaactacatgaagaatgcagaagcctcaggagccgatgcgatcagctggtagaaatggtatcagtgatggaatatgaaatgaatgaaatgaagtgagaagggaagtttagagaaaaaagaataaaaagaaacaaagcctccaagaaatatgggactatgtgaaaagaccaaatctatgtctgattggtgtacctgaaattgacggggagaatggaaccaagttggaaaacactctgcaggatattatccaggagaacttccccaatctagcaaggcaggccaacattcagattcaggaaatacaaagaacgccacaaagatattcctcgagaagagcagctccaagacacataattgtcagattcaccaaagttgaaacgaaggaaaaaatgttcagggcagccagagagaaaggtcgggttacccagaaagggaagcccatcagtctaacagctaatctcttggcagaaactctacaagccagaagagagtgggggccaatattcaacattcttaaagaaaagaattttcaacccagaatttcatatccagccaaactaagcttcataagtgaaggggaaataaaatactttacagacaagcaaatgctgagagattttgtcaccaccaggcctgccctacaagagctcctgaaggaagcactaaacatggaaaggaacaacaggtaccagccactgcaaaatcatgccaaattgtaaagaccatcaaggctaggaagaaactgcatcaactaacgagtaaaataaccagctaacatcataatgacaggatcaaattcacacataacaatattaactttaaatgtaaatggactaaatgctccaattaaaagacacagactggcaaattggataaagagtcaagaaccatcagtgtgctgtattcaggaaacccatctcacgtgcagagacacacacaggctcaaaacaaaaggatggaggaagatctaccaagcaaatggaaaacaaaaaaagtcaggggttgcaatcctcgtctctgataaaacagactttaaaccaacaaagatcaaaagagacaaagaaggccattacataatggtaaagggatcaattcaacaagaagagctaactatcctaaatatatatgcacccaatacaggagcatccagattcataaagcaagtcctgagtgacctacaaacagacttagactcccacacaataataatgggagactttaacagcccactgtcaacattagacagatcaacgggacagaaagttaacaaggatacccaggaattgaactcagctctgcaccaagcggacttaatagacatctacagaactctccatcacaaatcaacagaatatacatttttttcagcaccacaccacacctattccaaaattgaccacgtggttcgaagcaaagctctcctcagcaaatggaaaaaaacagaaattataacaaactgtctctcagaccacagtgcaatcaaactagaactcaggattaggaaacccactcaaaaccactcaactacatggaaactgaacaacctggtcctgaatgactactgggtacataacaaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctaggagaaggcaagaaataactaagatcagagcagaactgaaggaaatagagacacaaaaaacccttcaaataattaatgaatccaggagctggtttttggaaaggatcaacaaaattgatagaccactagcaagactaataaagaagaaaagagagtagaaaaataaaaaatgataaagaggatatcaccactgatcccacagaaatgcaaactaccatcagagaatactacaaacacctctacacaaataaactagaaaatctagaagaaatggataaattcctcaacacatacaccctcccaagactaaaccaggaagagttgaatctctgaatagaccaataacaggctctgaaattgtggctataatcaatagcttaccaaccaaaaagagtccaggcccagatggattcacagccgaattctaccagaggtacaaggaggaactggtaccattccttctgaaaccattccaatcaatagaaaaagaaggaatcctctctaactcattttatgaggccagcatcatcctgataccaaagcctggcagagacacaaccaaaaaagagaattttaggccaatatccttgatgaacattgatgcaaaaatcctcagtaaaatactagcaaaccgaatccagcagcacatcaaaaagcttatccaccatgatcaagtgggcttcatccctgggatgcaaggctggttcaatatttgcaaatcaataaatgtaatccagcatataaacagaaccaaagacaaaaaccacatgattatctcaatagatgcagaaaagttctttgacaaaattcaacaacacttcatgctaaaaactctcaataaattaggtattgatgggacatatctcaaaataataagagctatatatgacaaacccacagccaatatcatactgaatgggcaaaaactggaagcattccctttgaaaactggcacaagacagggatgacctctctcaccactcctattcaacatagtgttggaagttctggccagggcaattacgcaggagaaggaaataaagagtattcaattaggaaaagaggaagtcaacttgtccctgtttgcagatgacatgattgtatatctagaaaaccccattgtctcagcccaaaatctccttaagctgataaacaacttcagcaaagtctcaggatacaaaatcaatgtgcaaaaatcacaagcattcttatacaccaataacagacaaacagagccaaatcatgagtgaactcccattcacaattgcttcaaagagaataaaataactaggaatccaacttacaagggacatgaaggacctcttcaaggagaactacaaaccactgctcaatgaaataaaagaggatacaaagaaatggaagaacattccatgctcatggataggaagaatcaatattgtgaaaatggccatactgtccaaggtaatttatagattcaatgccatccccatcaagctaccaatgactttcttcacagaattggaaaaaactaccttaaagttcatatggaaccaaaaaagagcctgcatcgccaagtcaatcctaagccaaaagagcaaagctggaggcatcacactacctgacttcaaacaatactacaaggctacagtaaccaaaacagcatggtactggtaccaaagcagagatatagatcaatggaacagaacagagccctcagaaataacactgcatgtctacaactatctgatctttgacaaacctgagaaaaacaagcaatgggaaaaggattccctatttaataaatggtgctgggaaaactggctagccatatgtagaaagctgaaactggatcccttccttacaccttatacaaaaattaattcaagatggagtaaagacttaaatgttagacctaaaaccataaaaaccctagaagaaaacctaggcattatcattcaggacataggcatgggcaaggacttcatgtctaaaacaccaaaagcaatggcaacaaaagcaaaaattgacaaatggggtctaattaaactaaagagcttctgcacagcaaaagaaactaccatcagagtgaacaggcagcctacaaaatgggagaaaattttcgcaacctactcatctgacaaagggataatatccagaatctacaatgaactcaaacaaatctacaggaaaaaaacaaacaacaccatcaaaaagtgggcaaaggacatgaacagacacttctcaaaagaagacatttatgcagccaaaaaacacatgaaaaaatgctcaccatcactggctatcagagaaatgcaaatcaaaaccacaatgagataccatctcacaccagttgttagaatggcgatcattaaaaagtcaggaaacaacaggtgctggataggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactgtaaatcatgctgctataaagacacatgcacactatgtttattgcggcactattcacaatagcaaagacttggaaccaacccgaatgtccaacaatgatagactggattaagaaaatgtggcacatatacaccacggaatactatgcagccataaaaatgatgagttcatgtcctttgtagggacatggatgaaattggaaatcatcattctgagtaaactatcgcaagaacaaaaaaccaaacaccgcatattctcactcataggtgggaattgaacaatgagaacacatggacacaggaaggggaacatcacactctggggactgttgtgggggtggaggagggggaagggatagctttaggagatatacctaatgctaaatgacgagttaatgggtgcagcacaccagcatgccacatgtatacacatgtgactaacctgcacattgtgcacatgtaccctgaaacttaaagtataataataataaaagaaaaaaaaagaaaaagaggtttaatggactcacagttccacatggctggtgaggcctcacagtcatggtagagggtgaatgaggagcaaaagcatgtcttgcatggcggcagaaaagaaagcatgtgcaggggaactgccctttataaaaccatcagatctcatgagacttattcactgtcatgagaacagcacaagaaaaacctgcccccatgattcaattaccttccaccagctccctctcatgacacatgcggattatgggaggtgcaattcaagatgtgatttgtatggggacacagccaaaccatatcaccatgacatacaatttgccgattcagcaacagttttcaggtcttctatttttaagcctaatgcaatatattttatgaattcttcctatttatgtttttccttttaaataagttctactatcttaactatcactttcaaatataatgcaagctacatatgccattttaaattttttagtagttacatttaaaaagagggtgaaattaattttaacaaagtaggttatttatcccaatatatccaaactattatcattttgacatgtagtgaagctaataaaagcattcattgttaatgatctatctcttacattattttttcctaataaatcttcagaatctgggtgtgcattttaactttccagcacatctcaactgggatgtgaaattttcagcaattaaagtgaaatatagccctatcaaaactattaatgttgcatttaggaaaaagatatttttcactctttttatttttaaatttgagtttaaattaattaaaatggaataaaatttaaaattcaattctctgtcacactagccacatttcaagtgctcaatacctacgaaagacccatggctaccatattggacagcacagatctaagctcttattgctcagaatgtggtccccagagcagaatcaacagcatctgtgaacttatcaaaagtgcagtatttcagttcacacctactgaatctgcattttaacacaatccccaggtgatgcttgttcacatgaaagttgtgtctctctaaatcgcagatcttttcaacaaagagcccagaaaaagcacatgaatcaataactgtgaggaataaggaaacttgccacaggagaatggtgccagggttggcattaatgatgtgctctggtgaaaagtcgtaggtttcccacaaaggcaaccatggctattctattgtttgaactgacacagagccattctagagcttggagttggctctgctcccagaatctacatcaaagaatctaacactaacttccatgactaccacaattaaggcagctgcacaccccaccactatatatatttgaaattgcaactttagaacccctgtaacacagccgtgagcatgtttctgctatacacaagtggaatttaaggtcgaacctccctgggagaccccaggaagatcacccacaagagtggcttttgttgtctgcctcactgtcatcctctgagagctaacacagacacagtcaacatcctcttatatggaggttggcccagatgcccctggggattcaatgtattctgcttcacctcactaatccttatttggtttgtttttcacagaactcagtatttgatgggcctttcaatattttcctttaaggaattcattgtactaatataacatagaagctcattgttctaataagtggtccccaatgttggctgcacattagaatcacctggggcattttgaaaaataccaatgcccaggcatcaccccaatctaattaaattaaacctgtggaaggtattttgttaaagatccccaagtgattacaatgtgcagccagagttgaaatccactggtccaattagaaggaggccttagctagcggtcaggtgcccaaggaaaggcatctcaagttttaatgcgcatacagatagcttgggatttgttaaaatgcagattctgatccagtaggtatgggtggaaataaacccatgtttgtgtacagatgtttctcttgtggtatgtggttggtaatcatcctcagtatgtttccatttccggcaaactgggttgagttgatgaccctattcttactcctccctgaaacctttgtctctccctcaggctcccagttctcattaatcactactttctgtgatattctgaagcaattattatctttaactgccttttttcattagctacttctctatctgcttatgtacgtgagttatttcctctactggattacgatcttcaaggtagatccaaatatcatgtcatttttataattctcactgcacctaaagagtgccttacacacaaatgccacttgttgattaattgaaacagggaatagctgatgtgatcatctcaaaaaatatccaaaagacttaaaaatgcaagatatttttctttgttggacagaaaaagaaagtttagataggcaagggggtaggagatattgaggctttcaatttttatttcactcggtacatatttaaattttgaagaattattttgtaatttagtgattttaattatttgttgggaatagggcactattgacattttggactagatcattctttgttgtggctgtcatcctgtgcattgtaatatgtttcacagcatccctggcctcaacccactagatgccagtatcaccctttaccccagtcttgagaaccaaaaatgtctccagtcattgcaaaatgtctcctgggaaactcattcatggttgagaacccttagtttagaaaaatggaagtgtgacacagctgtcttaccgcactaatatagacctgaaaaaaataaaaaattaaaaacatgcacataagagaatgacaagctatgttctgagcaatatgtgtatatataaatattaatataaaaatgttctctgttcctgcgttttggaggccatgtgcttgtagaccatatttatctttgtatttgtcatcttggtcattctctttataaaaatagaggtatattgcatgccaatgctcctcagcttatgaggttacatcccaataagcctgttgtaaatttaaaaaatcataagttagaaatgtcaaaacttgaaaatgcatttaataccctgataaacacatcataaagttgaaaaatcctaagtcaatccatcatgagtcaggaactatttgtatatgaaacatttttaaaatctgaacatagacttaggaattttaatatgtagtggtagtaattccaccaagcaagagaatacatagagcaaaaatcattaagaaacagtgactgagatgattctcattctcaggaaactggtccagcccctttacataaaatattctgttcagtgtgctgtgatccttggactgaatatactgttttagcaagcagagttgttaagctaaagcctgcacatcaacaggtgttcaatgtctgctgaataaatgaagaatgaatgaatattaactgcacctctaaaccctaaaattaaaaagctttaatgtgctcatcacaaaagaccctattttgttgcatttgaaatttcaagcttcaaaaatgaaattacatgcaaaagtatattatcatcaatgagaataaatggcctcaacaaaattacaagatagaaaacaaagtttcatttgtcagttggtttcttctggcaatagaaggctccccttagacttcattagcttcagatatttcagtgacagaaatttaatgttggcaaagcattgctatactttcaggcttggattggaatgccccacatttactttttcctaccattcctggctaaaaacttgaatgtgagaaccagacacaaggctctagtggtagcaagcagaatgtctcctaagctccaaggggaaaaaatgatataagtcagtggttcccaaattaaccatcaaatgctacccattaaaatcactggggaacttttaaaaattaaatgcccaactaacaacaaactgtatgaaaaagaaatttagaaaacaatcctatttttaaaagcagcaaaaaagtaaaatacttaggagtaaatttaaccaaggaagggaaatatctgtttactgaaaactatgaaatgttgatgaaagaaattgaagatggtaaaaataaatgaaaagataaatatgtatggattggaagaattaatattgttaagagatctatactacccaaagcaatctatagattcaatgcaatcctatcaaaattccaaagtcattctttatagcagtagaaaaaaatcataaaattcatatggaaccacaaaagactctgaatagccaaagcaatcttgaccaaaaagagcaatgctggaagcatcacattatcagatttcaaaatatattacaaagctacaatattcaaaatagcatgctactggcattaaaacagatctatcaactactgaaacagaatagtgagcccagaaataaacccacacatctatgatcaattgattttcaacaaagataccaagaacacacaatggggaaagacagtgtcttcaataaatggtgctgagaaaactggaaatccacatgctgaagaatgaaattagatccttatctcatcccttatacaagaatcaactcaaaatagattaaagacttaaacataagccctgaaactataaaactaatgcagaaaatatagggggaaatctacatgatattaatctaggcagaagtttcatggatatgacctcaaaagcacagacaacaaaagcaaaaatagacaaatggcattgcatcagactaaaaaacttctgtacagcagatgaagcaacaaatagagtgaagagacaacctacagattaggagaaaatatttgcaaatcatatattagataaggggttaatattccaaaaggtacaaggaaatcaaactactcaataacaagaaagccaattaccctattaaaatatagggatagcattgggagatacacctaatgctagatgacgagttagtgggtgcagtgcaccagcatggcacatgtatacatatgtaactaacctgcacaaggtgcacatgtaccctaaaacttaaagtataataataattttttttaaaaaaaagcaaaaattaaaaaaaaaaaaaaaatatatatatatatataggcaacaaacttaaatagacatttctcaaaagaagcaagtatcaccctgatttaaaacctggcaaagacacaatgagaaaacaaactacaggccaacatctctgatgaacatagacacaaaaatccttgacaaaatactagcaaactgaatacagcagcacatcaaaaagttaatttgccatgataaactagtgtgttagggtgttctagcatgctattaaaaaatacccaagactgagtaatttataaagaacaaaggcttaatttgttcatggttctgcagcctgtacaagcatggtgccagcacctggccagcttctggggaagcctcatgaaatttttattcatggcagaaggtgaaacaggaacaggcacatcacacaggggaagcaggagtaagagagagtgtgagggaggtgccacacacttaaacaatcaggtctcacaagtactcactcactactgcaaggacagcaccaagccataagggcccacccccatgattcaaacacctcccaccaagacccacctccaacattgggcattatatgtcaacatgagatttgaacagatacaaatattcaaactatatcaagtaggcttccttcttgggattcaaggttggttcaacatacacagatcaataaatctgactcaccacataaacagaattataaacaaaaaccacatgatttcaataggtgtgggaaaagcttttgataaaatccaacctcccttcatgttaaaaaaaaaaaaaaaaaccttaagaaactaggcggccgggcgcggtggctcacacctgtaatcccagcactttgggaggccgaggtgggcggatcacgaggtcaggagatcgagaccatcccggctaaaacggtgaaacccagtctctactaaaaatacaaaaaattagccgggcgtaggggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaagaaactaggcattgaaggaatatttctcaaaatagtaagagccatctgtgacaaacccacaacaacataataataaatgggcaaaaactggaagcgttccccttgaagacaagaaaaggatgccttttctcacctgttgtattcatgacagtacttgaagtgctagccagagcaatcaggtaaaagaaagaaataaaagacatcaaaatagaaaaagaagaaatcaaactacctctctttactgactatataattctatgcctagaaaaacctaaaggctccaccaaaaaagctcttggaactgataaacaacttcagtaaagtttctggatacaaaatcaatgtgcaaaaatcagtagcatttctatacagcaatagtgttcacattgagagccaaaccaagaatgtaatcccatttacagtagccacaaaagaaataaagtacaactagggatacatctaaccaaggagatgaaagatctcataatgctgcacaagtacagccatttaatcttcaacaaagatgacaaaattagcaatggggaaaggactctctagtcagtaaatggtactgggataaatgtaaatgtcagtaaatggctagtcagtaagtgatactgactagctatatgtagaagaatgaaactggacccctacctttcaccatatacaaaaattaactcaggatggattaattattcaaatgtaatatctcaaactataagaatgtaatattcaaatatatctcaaatgatatacaaactataagatatatattatatctcaagctatatacaaactataagaatgtaatattcaaatgtaatatctcaaactataagaatcctataagaaaacctaggaaacaccattctggacatcagccttggaaaagaatttatgactgagttctcaaaagcaatttcaacaaaaacaaaaactgacaagtttttctgtgtagaagctcttagtttaagaaaaagaaaccagcaacagagtaaacagcctacagaatgggtgaaaatcttcacaaactgtgcttccaaccaagatctaatatctggcgtctgttaggaacttaaacaattgagcaaacaaaaaacaaccccatttaaaaatgggcaagcagcatgaacagacagttctcaaaagaaggcatataaacagctaacaaacatgaaaaaatgtctcacatcactaatcatcagagaaatgcaaatcaaaaccacaataatatgctatatcacaccagtcagaatagctattatcaaaaagtcaaaaacaacagacgctggcaaggctgcagaaaaaaaagtgaacgctcatacacggttgctgggaatgtaagttagttcagccactgtgaaaagcagtttggagatttctcaaagaacttgaaacagagttaccattcaacccagcaatcccactgggtatatatccaaaagaaagtacattgtttcttttggatattgttctacccaaaagacacatacactcacatgttcattacaacactgttcgcaatagcaaagacatggaatcaacctaggtgcccaacaaaggtggattggattaaaaaatgtggtacatgtccaccatgggatactacacagcaataaaaaagaatgaaatcatgtcctttgcagcaacatggatgcagctggaggccattatactaagtgaggtaatacaggaacagaaaaccaaatactgcatgtttttacttataagtgggagctaaacattgggtaaacatggatataaaggtggcaacaatagaaactggggactaacagagtagggaggtagggagcagagagaggactaaaaaactattaggtactatgctcattccctgggtgatgggatcaatcataccccaaacctcagcatcgtgtgatatacccaggtaacaaacctgcacatttgttccctgaatctaaaataaaagttgaaattacaatttttaaaaggatagaaactagtcatcagcgtgttttttaattttccaggtgactctaacattcaataattattttaaataattatttctgtctgtagaccttctgccagctactaagtttcaggaattttgatggtctcattaaagagaacctgacaaccccacttacaagtgcttcagctaagtttcatttataatattttcatattgccaaggatccagtagtgtcttttttacagtgagttacaaattcctgtttttgtgacagtgacaggccaaaattaatgagctgtgatttttaaactgaaaaagtgactgtccaatagaggctaaaaagaaaactaaaattatattttgtcaattttagtgttaagtgtgattttttgctttgtatgttttagatagtttttttattgagataaaacccaaatagcataaaatccacctttttaatctcaaagtggtttttggtatattcacaatgttgtgcaacaatcactactatctaactctagaacattttcattacttcctcatggaaccctgtacccattagtagtcactcccagtttcccattcacctcatttcctggcaaccactaatctacttttctgtctctctgtatgtgactattcttaacatttcatgtaaatcagatactataatatgtggccttttatgtctgacttctatcacatagcaacatattttcaaggtcattcgtgttgtagcatgtatcagtattttattcctttttaagacaatactttattataggattataccacatcttttttatccactcatcagttgatggacctttgagttgtttctacttttctgttattttaaataatgctgttatgagcattcttgcacatgtttttgtgtgatcatatgtgtttgcttctctgggcatatacctaggagcagaattgcagggtcatatggtaactctgtatttaacattttgaggaacccccaaattgctttccccagtagctataccattttacattctgaacagaagtgtgtgagggtttctattacttcacatcctcttgctttctattttaattatttaattatttaatttaattatctaagatgccttttaccctaaccaaccagaaaataaacttgactgaatttagtgctaattgtttttgcatagtcattcagtataattgtctttgacatctcaaaacactgcttatgcagaatacacttttttaaaacagtgaaatcatagcaattctatttcctaagtcagttcttcttcagggtagtaagttataggtctttgaggtcatgttcctgtttccatcttccaaaaggcaacattattaaaatcttgttgctgtatctgccttggcatatccccctctctatccagagaaaagatcactgacagaatagtgtccccacctttctatcttagaggtctcattacgagtcagtatgcttttaaaagaattaatggataaagagctagacatcaagaagaagagagaaaattttaaataagacagaggagtgtatgatcactctttctaagatgattaaatgaaataatttgaaaggcaataaactaactgcaccaagtaaatcttgtgaaagcgaaaggaaagaggagaaggaagatttgagtgctgaaaaccaggataaattgtattcaaccaccagcattaagggaagttatacaatacattttatgaagaaagtgttccatgaaaataaaacaacaaaaagaaagtttggtgaaggtttaaatgataaatgccaatagtagtatatgtgcaattatctactgacactgctatacaaatgagctatctatataggctgtgaccacataacctcacctgccaaaccacagtactataaataaatacttttcccagacactacagagctcagttgacttgagattcatcttatggtaactggaaatgtagactgtgcctttatttgggtcaatcctacaattttctttaatgtaccagcaattcattatttaaagtttactagagtttaatttaaaattataaaaaaggaagaaattggctgggtatggtggctcacgcctgtaatcccagcactttgggaggccaaggcgggaagatcatgaggtcaggagatcgagaccctcctggccaaaatggtgaaacccagtctctactaaaaatacaaaaattacctgggcatggtggcacacgcctgtagtcccagctactcaggaggctgaggcaggagaatcgcttgaacctgggaggcggaggttgcagtgagccaagatctcaccactgcactccaacttggtgacagagcgagactccatataaaaaaaaaaggaagaaattaatagttcaggtgagaacttgtgaatttttattctcaactctaagctagtaagtgcttaaatagaagactttacaacgagctgtaccttcttaattctacagagaatcatgaggaaaatcaaatataaatgtgaatttcttatgttcagtattgtccaaaaagaaaatattttattaaattttttgtcagttgccatcattatttaaagccttcctgccagtagcctatactatttttggaatggagtgtttgcagtttcataaccacttgataacaccataggttaaaaaaaaagtctaccagtctttttcagatggcctctttgacaatgcattatttatagggaagttcagttacttttaacaataaagacaagccaaaagaaattacagatctcttttaccatattttgatatactagcagcatccactcaggacaggacctttattaaaagggggcttaaggtacttttaattggaggaattactgaattcctgaagctcttcaaacaaaatagcacttgggatatgacaagagtactttggagaaggctgcttggtcccaaagcagagattcaagaggaggactccagctagctgggtaaggggttccttcctctcaacctaagtgtttatgtaagcctgctgggggccaggaactgcgtaaaactcagtaagctcagtacttctcagcacagaatccagtcccaaggaagcacccagcaaaaatttaggttgaattttctttaaaataaaataaagaaaaaagtaaaattaaaaaaaaaatacaattcaactactcagcccattccattccgggtagttttggctcagaatgctggaagagttggataggctattagtgagagaactcaaaactccccaaactccacttcattactcttcctttatattttttctgaaaagagtattgccaatatatcaataaagctttttgctatgacttcagagtgcccaggtcactagggaaaagtatcaagtagcatcctgaatccacaaatcctttgagagccagccacacagtatctgcgtgagtgtggtaattctctacccttacgagtgtcatcacagaattgcagcattctcttttcattgtttctcaggaaaacatagacaaaggctctgcttggatttttttaatttaacactaatatgtaataatatagcaacatctcctagttatctagaactcaggctttgatagctgtgactgtctagaatacaaccacagaaaatcacctctgaacagtgagggaaatagctgccacagtatcaccacctactccaagcttgaacctctcaacccgcaaccaacagactgcaagtagttcagtacagctttgaatgcagcccaagacaaactcgtaaaccttcttaaaacattatgaaatttttttgcaacttgttcatcagctatcgttagtgttagtatattttttgtgttgctcaagacaagtctcttcttccagtgtagcccaggaaagccaaaagattggacacctatactttggatgtttcatctagtaccgatatacttataattacatgtttcaactagtactaatgaacttatagttacaggatgaaatttcaaattagcaatgttcatcatttgctcttcctaggtaacaacagttaacaaatcataggttgacaatcacaactgattgtgaggatggaaataataacaatgagcatttatataatgcttactctataccaggcacttttctaagaactttacatagattagctcacttaatctttacaataaccctgtgacataccattattatccccattttacaggtgaggaaactgaagaagttaagtaatttgcccaagattacagattgtatgtgattgaggtaggatttgaactcagcagtctggcaccaaaatcagcactctcagcctctacccagtattatcaaaagtaatttcctggtagcttctttcaattgtcatggcaactctcaagataaagaattattgtttttaataaataatgtcattcccagaaatgaattatgtgtgaatcatactaagctgcagtgagagaatgaatatcaccatcacagtggtgaatctacttagtgtaggggtaaaaggccagtctctcccagcagccctgcacataggtacaccgtaattcactaggataatccctgatcgccatgctgtcataaaaaaacgttaaatgatgtttaacaggtttcattaatgattcagagaatcttataatatgtcttaggaaaaataatttcaggagtaactttcagttagctagacaatacagttctgttgagcatctcataatctatgccagacaaaggaaacattcttgcctttctttgagggaattatagaccaacaattttattaattttcaactttcatcgaggcaagattagcttcatgaacaatgtttctcaaactgaaagtagtgacctgtattagtaaatcaatttatagggttgcaagcagcatcatttataaactgaaatcagaattcattgcaggcagtaattttgagacattttattttacatgtgcgtgtgtatatctatcatataaataagtatgtgagaacattttaaaacatttaaaatatatttatatatctaaagtttaaatgtaaatatatatttatattaataatataattaatatgaattaataacatattaattcatattaacttatattaatttatattaacaatatgtaaacaatatattaattagtaatatattatactaatattagtatgtattaatatattattataatatattatatattaattaatatattatatattgtatattatatattaattaatatattatatattgtatattatatattaataacatactattattaatattttaaatatattttaatatacttaaatttatacttaaaatttacatatacatataaataattttcctgaaagtcactttcaaaaactttgaaagccaccagtgcagtggttaagaatacaaattttgggctgggcatggtggctcacacctgtaatcccaacactttgggaggccgaggtgggtggatcccgaggtcaagagattgagaccatcctggccaacatggtgaaacattgtctctactaaaaatataaaaattagctgggcacggtggcacgcacctgtagtcccagctatgcaggaggctgaggcaggagaatcacttgaacccaggaggtggaggttgcagtgagccgagatcatggcactgcattccagcctggcgacagagcgagactgcatctcaaaaaaaaaaaaagaatacaaattctgaagcacagctgttgagttggaatcatggctgtgccacttaataaccaagtgactttgggccagttattttacttctctatgcctcagtgtcatctattcagtagtgagaataatagtacctaactcattctagttttgagaatgaacactttttatattacatataaaatgtgtaggacagagaccccaaagaagccgtagttgctgtcatattgttattctgttcctgcttaagaaggggacttggaaaaataatgatgttgaatgcagtaacttctttcactcatggaagaattacatattcacatcttctttgctcatcaaacctttgaagatcatgcatgtctcattctgtaacatcgccttaaccaaatataaaggctaaatacaaaggtgtttttaaataactgatacatttaggccagtcacacaaagattttacccaaagcctatgcaggcatagtccaagaagtagacttgttctactgcaatcaccatctcttgtttattatttgtgaaaggaacattatggtttcaccacagttggcctggccaacgtgcttatgcagtcctcagaacatatgaaagtgatttcggctgacaataagtatttcctcactttggcttatgttcaataatagccattctttatccagatcagggtgactgagcatgctgtaaccattcttctcttctaaaactgacccttgtttgactgcatatgcagattgcttagcagaacccatatccaccataacgggccaaaagtcatttgatccaatgtgcttttctttttttttcttttttttttaattccatgaaattttattaagataaattaattataaacattgcaaaacacttttttttttagacagagtctcactatgtcacccaggctggggtgcagtgacacgatctcagctcactgcaacttccgactcccaggttcaagtgattcttgtgcctcagcctctctgagtagctgggattacaggtatgccccaccagacctggctaatttttgtatttttagtagagacggagtttcactatgttggacaggctggcctcgaactcctggcctcaggtaatccacccgcctcagcctcccaaagtgctggaattacaggtgtgagccactgctcccagccccaaacatgattttttgattgaatgcttaatgtctttctattattattatttttttttattatactttgttctggcatgcatgtgcacaacgtgcagatttgttacataggcatacatgtgccatgttggtttgctgcacccattaaaaattaattcaagatggattaaagacttaaatgttaggcctaaaaccataaaaaccctagaagaaaacctaggcaataccattcaggaaataggcatgggcaaagacttcatgactaaaacaccaaaaacaatggcaacaaaagccaaaattggcaaatgggatctaattaaactaaagagcttctgcacagcaaaagaaactaccagcagagtgaacaggcaacctacagaatgggagaaaatttttgcaatccgcccatctgacaaagggctaatatccagaatctacaaagaacttcaataaatttacaagaaaaaaaaaaaaccatcaaaaagtgggcaaaggatataaacagacacttctcaaaagaagacatttatgcagccaacagacacatgaaaaaatgctcatcatcactggtcatcagagaaatgcaaatcaaaaccacaatgagataccatttcacaccagttagaatggcgatcgttaaaaagtcaggaaacaacagatgctggagaggatgtggagaaataggaacgcttttacactgttggtgggagtgtaaattagttcaaccattgtggaagacagtgtggcaattcctcaaggatctagaactagaaataccatatgacccagtgatcccattactgggtatatacccaaaggattataaatcatgctactataaatacacatgcggccgggcgtggtggctcatgcctgtaatcccagcactttgggaggctgaggcaggcagatcacaagttcaggagatcgagaccatcctggctaacatggtgaaaccccatctctactaaaaatacaaaaaattaggcaggcgcagtggcgggcgcctgtagtcccagctactcgggaggctgaggcaggagaatggcatgaacccgggaggcggagcttgcagtgagccgagatagcgccactgcagtccagcctgggcaaaagggcaagactccgtctcaaaaaaaaaaaaaaaaaaaaagacatatgcacacgtacgtttactgcagcactattcacaatagcaaagacttggaaccaacccaaatgtccatcagtgatagactggataaagaaagtgtggcacatatacaccatggaatactatgcagccataaaaaaggatgagttcacgtcctttgcagggacatggatgaagctggaaaccatcattctcagcaaacgatcacaagagcagaaaaccaaacaccacatgtgtgttccaacttaactcattgttcttagtgataattcacttaggggcaaagttaggctctcttgttaattgcaacattcctttcagaggtgctataaatggatgttgaactatactatttttagatttaatctttaaaaatcataagaaagcaagaaatattactagttcagaaatgattttctgttcctggctaatcagagaagacctaagagtctatagtagtcatttgttgtcttcgtagtaaaagtaagattctaataggatttttagacatagtgagaaaggtgttcattttaagattatggtagttcctctcagatttagaaagccttaagatgacactaaggagttggactttaggaatgctgagtgtcttcagccacagcggcacaatggtactagatgtgacaggatgtgattaaggagaaactaaacggccaggcacaatatagttcttcttgcctccaaaagaggagtcacccactttctcacactcactgtgatacattccatttgctaagaaaagtggcttgtgtcattcttgagcactacttttaagttctgatatattaaattcatttactctgtattaatagcattcaaatatttagtaaagttaatatacctctcacactttttccaaagtaacccaccagctgtgtcctgtgcttcaagctatcttataagactgcaatcaaagtgtcagccagggctgtggtctcatctgaaggctggatagggaaagattggttcccatgcttatttacattgttgttggcaggattcagttcctcaaaggttttttttatttttatatatttttttttgagatggagtcttgctccatcaccagactggagtgcagtggcgcaatcttggctcactgcaaactccgcttcccaggttcaagcaattctcctgcctcagcctcccaggtagctgggattacaggtgcatgccaccatgcccagctaatttttctatttttagtagagatgggatttcaccatgttggtcaggctggtctcgatctcgtgacctcatgatccacctacctcagcctcccaaagtgctgggattacaggcatgagccaccgcgcccagccagttcctcaagggtttttatactgagggcctctacttcttgctgagtgttggccagaggccatgcttagttctctgctgtatggttctcaccacacagcaacgtacttcatcaaaaccagcaaaagggtgagtctgctagttaaaaagaagtctcaatcttttgtaacctaatcatagaactgccatccactccatgctgccatattcttctgattagaagcaagttactcaagggaaggaaatacataaggctgtgaatgagagaagacaggaatcattggaggctactttaggggctgtctgccacagcacttaacagcacatacccagccataaaatttaaaaaagccggaaagagagaaggagggtgcagggtaaaataaagaaaagaggaaggtggaagggaagaaaggaagggaaagaaagacatttaaaaagacaagaacaaaacagctctgctgcacaacatctgtatcggagttccatgtgcagacacacacgtcatcacatcagcaccacacccataaatttcctatttcttatttacaatgagaaggtaataaggactttctatgcatctggagttaaaaggaaacaataaatctaagaatactaagtttaagtaatcaaaatgtgtttcagattagttattttttctttttaagtttttttttttgtttcagctgacaaagttttttatttctttctgtttcaagttttgaagttgagtttattattcttgctattatgtaacaggcatattttacagagaatataggaacctgattgacatttgtatttggtgttctattgttgtttcaattcaaatgccaaaattatgtttttgttgtgtacgttattgttcataattatatatgcctcttaattgtaaaagcgaagctgtaaaattgtaaagtactttgtgtctcatctattccaggcattctactaaggaaatcaagaccaaatggcttgggaaggtcaacgttaaatagtgtcagagccagaactagagtacacatctctcaatttctaatctagtgcatttccttttcttatttctgtgcaaacgaacagttagaatgtgaaatagtctcctcagatataccagcattaaaacagttgtggtttaaatatttagttttaataattactaactttgtagaaggacctaaaatagtgtttgttttcagtgcttcaactaatagtaaaaaggaatattttcagtgctttactgtatgagaggtgcttgcctaacgaaatacacatctttttcactgtactcatttgtaacagataatgtgggctcgtacacctcagtgttctgagaggggttggtaaacactgaccacatagagagagctgcccatctgccctcagtaccaaggcacatcccatccatgccctaaaactcttgtaaatttctccattcatacaggaaaatgagtatttcttacaacaatatgaccgtggaatttgattacaaaaacactcctgctatccccaacctgtgctcccagggctaaagacatatttgcaactcaggattttctgaagattcacttgtttgtactattgagggcaacagttgttctcaaacaaggatgcagttcctttcttcttaccctgcttatttttctttttattattattattattatactttaagttctggggtacatgtgcagaacgtgcaggtttgttacataggtatacatgtgccatggtggtttgctgcacccaccaacccgtcatctatattaggtatttctcctaatgttatccctcccccagccccacagccctcaacaggccccagtgtgtaaagttcccctccctgtgtatgtgtgttctcattgttcaactcccacttataagtgagaacatgtggtgtttggttttctgttcttgtgttagtttgctgaggatgatggtttgcagcttcatccatgtccctgcaaagaacatgaactcatccttttttatggctgagtagtattccatggtgcatatatgcaacattttctttaaccagtctatcactgatgggcatttgggttggttccaagtccttgctattgtgaacagtgctgcaataaacatacatgtgcaagtgtctttatagtagaatgatttataatcctttgggtatatacccagtgatgggattgctgggtcaaatggtatttctagttctagatccttgaggaattgccacactgtcttccacaatggttgaactaatttacactcccaccaacagtgtaaaagcgttcctatttctccacatcctctccagcatctgttttttcctgactttttaatgatcgccattctaactggtgtgaaatggtatctcattgtggttttgatttgcatttctctgatgaccggtgatgacgagcattttttcatgtgtctgttggctgcataaatgtcttcttttgagaagtgtctgtttatatcctttgcccactttttgatggggttgttttttttcttgtaaatttattgaagttctttgtagattctggatattagccctttgtcagatgggcagattgcaaaaatattcccccattctgtaggttgcctgttcactctgctggtagtttcttttgctgtgcagaagctctttagtttaattagatcccatttgtcaattttggcttttgttgctattgcttttggtgtcttagtcatgaagtctttgctcatgcctatttcctgaatggtattgcctaggttttcttctagggtttttatggttttgggtcttacgtttaagtctttaatccatcttgagttaatttttgtataagatgaaaggaagggatccagcttcagctttctgcgtatggctagccagttttcccaacaccatttattaaacagggaatcctttccccattgcttgtttttgtcaggtttgtcaaagatcaaatggttgtggatgtgtggtgttatttctgaggcctctgttctgttccattggtctatatatcttatttggtaccagtaccatgctgtctttgttactgtagccttgtagtatgaagtcagagacacaataaaaaaagaaaattttagaccaatatccctgatgaacactgatgcaaaaatcctcaataaaatactggcaaacctaatccagcagcacatcaaaaagcttatccaccccgatcaagtcggcttcatccctggaatgcaaggctggttcaacatacacaaatcaataaacgtaatccatcacagaaacagaaccagtgacaaaaccacatgattatctcaatagatgcagaaaaagccttcgacaaaattcaacagcctttcatgctaaaaactctcaattaactaggtattcatggaatgtatctcaaaataataagagctatttttgacaaacccacagccaatatcatactgaatgggcaaaagctagaagcattccctttgaaaaccggcataagaaaagaatgccctctctcaccattccttttcaacatattattcaaaactctggcgagggcagtcaggcaagagaaagaaataaagggtattcaattaggaaaagaggaaattcaattgtctctgtttgcagatgacatgattgtatatttagaaaaccccatcgtctcagcccaaaatctccttaagctgataagcaacttcagcaaagtctcaggatacgaaatcaaagtgcaaaaatcacaagcattcctatacaccagtaacagacagagagccaaatcacgagcaaactcccattcacaattgctacaaagagaataaaatacctaggaatacaacttacaaaggatgtgaaggacctcttcaaggagaactacaaaccactgctcaaggaaataagagaggacacaaacaaatggaaaaacatcctcatggataggaagaatcaatatcatgaaaatggccatattgcccaaagtaatttatagattcaatgctatccccatcaaactaccattgactttcttcacagaattggaaaaaaactactttagatttcatatggaaccaaaaatgagcctgcatagccaagataatcgtaagcaaaaagaacaaagctgaaggcatcacgctacctgacccagcttatttttctacataggatccccacatccctgcttttgctagaatggaaactagacaaggaccaacttttatcaacttgttcatttctctattcctagaacacagcctggtacaaaatttgcgtttaataatgtttgttgaatgaatttgaatgatggatttgtttagaaggtttataacatcccatgccttatgagtttgttgccagaggaaaaaagaagcctgtttttggttcataacatcaggtatgtaacctggaatttggaatcatgagtttttatgcatttgcttcatattatttatttttaagagatctttcaaagtattgacaaagatactttaagattgagagcctccctgataacccaggaatgagagttttagattaagtttacaatatgattgaaggctaatcatataaggagaaaaaaataagaaaaagaagagaaatttgaaaagaaatctccaaaatggccatggacatcagaacactgagaattcatacacaaaaatgtgttttgcttcatacctgtctgttgcacatctatacatttcatagatgcagaggaattttggctaaattcctaacacatgagaggcattctgcacttacttctcaaattagaattaacacatgagtatgtataagttgtttagagtgggcatctatttaatgagtttactggctgaatcttttaaaagaatgcaaacataagtgccttttatcaaaaatcaatgaaaagataaaaggccctgtagtgcatgctgtggttcccacactacatcccccacatccacctgatgtcatcacaactgtctatggtgtccatttgccactatgcaccctgccgggcagactcaggtgcctgcctcggcaaagaccctcagctcatgtgcaggtacagcctagaagtgcatgggggtgaacatctctgaggcacccttcaaccagtgagtactgggagcggtagataaatatcctagcctctcatctttctacacaacagtggtggtgcatattctacacagcttctcaaaggagcctcagagggattgggccccattagccactgtgataaccagctcagaacacacacatattagttgttctccctttccttcccaccctccccattccctgactgctagatccagaagtcatcttccagatgaactacctatatccaaatcctaatctctagctctggtttcttaaacaggtcctatgaaatgcttgaaataaaaggcaaaatggtttgtgtctagaatcaaaggctgacaatggcaagcaacaggcactaaaactatgacccaggaaaaatgcttttctggaagacatcggcattacctcctagacacggaatacactggcttcatcccagtagtttcttcacacactttagatacgtgtctcattaggatcacatatgactcacctgatttcatgccttgccttttctttttattctgcagattcttctaaggagcctaaattcaccaagtgccgttcacctgagcgagagactttttcatgccactggacagatgaggttcatcatggtacaaagaacctaggacccatacagctgttctataccagaaggtgccaccatcatgcctttctgattttcctctccatggatgtacctactaaagtacactgagtcagatgtactgtgggaatggaagtgatttgttgtgatttatgcaatcaatgaatattcattcactcatttattgaaaaaaatattaatcaagcccatcctatgtgctgagtactattttaggccctggagatatagcagtgattacaaaagacaaaatccctggtctcatggagatttccttccaatgcagggagacaggcaataaaaattgaattaaatgtcagctagtaatataggttattaagaaaaataaagccagaaagcagcatatcagcagtgtgtgggagtttgtgtatgtgcatgagaatgtgtgagagtgtgtcaaagtgtgagtgagagcatgtatggatacacgtgggcatgtgcatgtggatgagagtgtgtgtaaaaggcttgaatgatgctgaaatgcgtggtcctaggaggcctctctattgtggtgtcctagaccagagacataagtgaaacgggacaggccacgtgagtatctgggggaaaggctatgcaggcagaggaaattgcaagtacaaagtccctgaggcagtcttggcatatttgagggatgaaaaaggccagcactgaaggcacaagattgaaagtgaggagagtgatatgggaagggatcagagagttacttagggactgaccatgccaaacctcataggcaagggcaaggctttgaattttactttatttgtggtggaaagctgtaggtgtttttgaaaagatatatgctttaaaagatgtagctttgtttctaaccagataatacactccttctcttaaatatattcagtaaaagactgtagtactttttcatttttaccagtgaccctctaaaataacagaggaagggtgaaacaaagacctctcaatataggtaccatccaagttgtttatttcttccccttcacctggcattattttcatttttgtttactctcactgtgtatatttttcccttttttacattttaggcttaaacacttcattatctcctgttttccacccaacccccagagaaggcctaagccaagatgcagggttagtgaggaccctttatccttggctcaaggtgttcgttagtcagaggatgacattgtctatccaaccgaagagctggaatagggaaggaagatgcagccagcagttaagggtatgagctcagggctaacaaacctgcacttcagtgtagttctgcactttctcaccaaggaatactagggaaattagccagtttgtgtacaactcagcctcctcatttgcagaaaggagataatggacttgcctcatgacttcttgtgaggatcatatgagataacccatgaaaaatacttggcagagtacttgacacataataagtactcactaaatggtagctggtattcttcttatcggtagtatagtgataattttaaaataattatgatatagaaatccagttcctggactataaaatgactataaattgtataagaccatttataccagtaaattgttataattattttaattattggtataagagcattttaatgcagagctgctgcttaatttgcagataaaaaaatacttggagttagcaaccaagcagaccttccccacctttcagtataagagaggtctcttggatgaagtgaagtgaagatgaaatgtttgggcaccaagtatactatatttttccttaaggctgacaccacagagaggttggggccagtaaacagagttgatttctataaatacattcagacatgaagttagtatgtttgatgacacttttgaaatgtgtggaatcattaagttatttgtacaggcacaattagccaaactgtaaagaaaagtagcagaataacctcttaagctgggcccactttatgaaaataattttttgctacctcaatatttaccaaatttgatgagcaaaaagagaaatccaaaggaatgaagccttgataaatatatatcccttgccctcatcaatcagggtcacataactctgtccacaggcatcttatgcacactccagtcatttcagcatctctggttcaaatccaggatctacactaccaaggatgctgctgaaagtgtgactgggtaaagggaaacgttcagacatattcagaaagatgtcttagattttgccctggtagtgtttggaatcccaggagggtaagtacagcttcatgattaagtgccaacccaaacttacaaaattagatatttgtgttttttctataaaatataactattttgaatatcttagccaaactactatgagcccacagcccagtttatccaagaaggataaaactgagggattaggagtatcaggactggactggactgattagtgtacagttatatttgatttctcattgcccacttcacagagaagacaatacaaatgcactttctgactcttatcactgtttcttagaactcagttgccaggcaactcctgaaactatagaaacatgcttctcatccctgacacataaataaaactctgagatgattttatccaaagtcagagtcagtgggcagtgcagttgtttcagtttgctggcctggcctcagtatctaaagcacaacagaacgtgaacatgtcaggctgtcaacaggacagttcaggcacagccctacaggcagttgtgtgttttgcctggctctgctccttgccaggtggctggcagaaaaggcagcctccacatgttagagcagcagattcaaaacagtgtctgccatcctgtgatgacgatagtgccaaattcagcctctgagcttgcaggggactcaggatgaatgcacattacaggcatggtaaaaagaggctctgggaagcatgttcgagctgctctgctctcagctccttgcatgtaaatgctgtgtttttaaaggaagtgggcatgtgaacactcagtccttaaggctgtatcccccacctcttccatacccattcaaccccacttcaaaaattaccctggtcttaagagaaatttcattttctatacaaggttgtgtggaaaatcagtagggagaaagggcattattactttcatttttctttaacaaaagtattaaatttaaagccaaaaacgtgcgctttctgtcatgaaaacagctgcccttaaaaacataaatgatgttttatttttattacttttatctagttggttgtctttagatgaaaaacatttcttctgctctttattcttatttttaatgatagtctctttctatggttctcaccccttccatttcacaagatagtctgggagcaaacctaaagcacttaacttttgggagtaagagcagaggggagcttccatacattgattttggtcatctgtagagacattcaacccagagaaggcaagtgacacagtatctgttttatgagctaatttgggttcttgtctacatttaatagtttaaaatataagttataaatatttatttaaaatgaaattcaacattggttcatgaagaaagaggttggaagtagtgttttgaactagctgtttctgatccatcatgcttaaaataaatgctctgtttgtcctgtggagttcatggatttgggataatctaaacagggttttttaaacagtcctcatggggaacaaggtactgacatgcactgttgagaaattctgtgaatcatgaaagagctaatcttttagaaatccagacctgttaagcactaatctacatctttggaatatcttaatactttgagttttctaacttttatactatcacttatgctaagtacatttgatatcccttctattatgtgaaagcctcattttctgggcaattttcttacaactactctctttaatgcactcttacttaatttgaaagtaaatatcaaattaagcatactatagttcaatgaaccacccacctattcctaatttttttaacatttctcttctgactctacatacacacatacttacacacacacacacaaacacaccttatcttttcttctgccttttgcccatttactttttgcatcagagatgaatctctcattcaagcatatgcaactttttttttttttgagatggagtcttgctttggcacccaggctggagtgcagtggctcgatcttggcttactgcaaactttgcctcctgcgttcaagcaattctcctgcctcagcctacctaccgaatagctgggattacagaagcatgccatcatgcccagctaatttttgtatttttagtacagatggggttttaccatgttagccaggctggtctcaatctcctaacccatgatccgcctgcctcagcctccgaaagtgctgggattacaggcatgaaccaccgtacccagccagcatatgcaacttttaagagtctcaaccaaagcagcaattcactgtctcagaccctggagtctctgccatttaaatcccaatttccttccaacagctgaggagcagctgtctcaaggaccctctgatactacacaagttttctcctagtgccaagcagaccagcctgagaaacagctataagaaggaaataggcgtcttctcccagcttggcatcctttccttccaggccctgccttccctacaacctgcattgtcttcattgtccactgctgcccagcacccatcccacagagggatggtcccaaacctccacagtctggcctgtgagccacaggcgcctctgcctgcacagggccattcctacctcatcttccacaaccacagattacatggttttatgtccctttgacttatatattgtcttctcaattaataggctagtgaataacatggagatgatgaactacctcacccaagtagcaattctaatttaagaaaattttcctgtcattccattgccttttacttccattaccacactcatgcccatacttccttacctcaatccctttgacctctctgtttattcccttccttgccgtattgccatctattaaacttttacccatccttcaagaatgctaaaaacatacctccaccttgaagccttccatgaagagccagagcaatcattccctcttctgaacttttaaggaccctagagagcactactaatgagcacttacccacattgctttgtaatatggttttttactctttccttctgaggcaggaggaattccttagacatctatgaatcccatagtgtctgtcattatgttttagacataaccaattctcattaaatgtcaatagaatgaatataagaggcccaaaaaactactcagatgggaatttgagtcttattttagcctgaaattaggggaccacatcttacttatctttatatctgcacagcgttggtgctggatataatgcatcactctgcctggagcacacatcaacttgtctcctcagtttctttcaccataggctggtgaaacagccaggtctaaaccttcactgttctctgggaatctctagtttgggggtgattctctgtactgttttaatgaacatttttaaaatgtccctaagtctcagaaccttcatctatacaactggcataataaagtacctaccataggaatcgatttatgagcaggcatagcatattcattcaataaacggaagttttaccataggcagaagtaccaaacggcctcgtagcagtcgtcagacactgatgatactgtccactgatgtgatatgtctcggaaatgatgttactaaaatacctcttcacaaaatatttgtcttccaatttattgaatcagactatcaagcaccttacttggacttaagctacaacatgatttttggaacaattaatctttttttaacccttcattttaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaataggtaaatcacaggtttttgtttcatttgacatagttttagactaaataaatggggaagcctgcaaggtccaagtataatcaagtaggaagactttgtaacagtgttctatagatacatggagatctgttttacaggagatgggatcagctggtgaacaagaggaaaagggcagggggaacttaagttgactttaacataaagtagcctggcagtaaatgttgtgaagaagagaataggaaccttgtggagtcttttcctttaggatatctttgaagctgcgttgtgtttttatgttccactgcaaagggtgaacttaatatattcttaggatttcttacttcctaattatttgataggatccttatattcaaattcactgaaatacgttggcctttgacctctaccattgctgtaatcaaagcctagattttctttatcacaaagcataatcattctggaattttacatttacaaaacagccacagttactttaaagacatgtttattagatctcagaacaaatactggagacaatcagctcagtgaactaagtgaaagatccaaacagaggatcctttgcccatcatatggacacaaggtggaaacaaaacaaataaaacaaacaattgtaattagaatagtcatgtttataccttaatagtataaatagcaaaatagaaagaatcaaagaaggactttgagtagctgaaattagtgcctcaaaatctatccacaaaagctcatttgttgcttataggaatttctcgttgcttctcccaaatgtattgttctttttatgtggttttctaggcataagctgactggaagacataggagtatgtggctagaacttacagatagaaacaaataaaatctaataggctgactttaagggagaagattaagagaactgtatcaagcagtaaagataacccaattgctttgcaaagacaatttagtatgtgtcctaacatcactgggtatagctgttgagttgaaactaaatgggatagcagaatgggatagtagcaagaacactgggttaaaacccatgttctagccctgttctctgccaatagccagtcctactcatttacctggctgacatgcctgtcatgtgtcacgcactgttctggtggtggtggttatagaataagtacaatacagtcaaagagggaagtcaggcatgttcacaaataattgcagtgcagcgtgataggtgttagcctggaaatacgtggaatgcagagctgcaaaggtggtggccaaaggcgtgaatgactgacaggcctgagggatgaggaagggctgcacagagatggtgacagtttagttacctctgaactggaattggactctccctatttttaaaaaagtgatgacccacagtggtcaaaagcatgagtgagtattgtcaggtaccacagtggacttgcctttcagtaactactaagttccaacagtaacttagtagttacttagtaattacaacagtaacttagtagtcccaacatgttcagggactcaggagcagttaggaagccctcctagtcagctggagaaatcatcagtagttgtttgtgccccaaaaaggaatttggactttaactgtcacgaggtacctttgaggatgtttaaatagggaaattacttgaggatactaatagttaacagtcacaaaagtcttaccatgtgtcaggtataaaaaccatcttttgcaatcacactttacagataatgaaaccgaggcacagagcagttaaaggactagttcaagtcaaacagctagtagatagagctgggatttgaacctccagcctccatgctcttactcttgaggctttgcagtaccacttgtctctttattaatgctcagagaaattaatcttgttgcaatgtgaaacgtagattggagtgggacggactagaggtagaagaggttaaaagactgagatgatcaaggtaaaagattatgacaggtagctacaactagcacaatagttgtggggcaaggtgctgagagtgaaagagaacaaagaactaatgtaaccctggtagatcttgagaaagttgtcaatcattataagcctcagcttcctcataaaatatgtatgtatggtactacctcacagggctattctttggatttgaagtactatattagttagacatttgtcattcattcaattcattcagcaaatatttattatgctcttctctcaggccagtcaatgttctccatgctggggatagaaactgtcttccctggtgggatttaatcccaacgaggatggaaagcgacaatgctatggagaaatataggaaaggagaataggagtgttggagaggttgcagtgttgagttttcaggattggcatccctgaggcagtggcatttgaataaagaaggattggagaggataattatgtgtgtgtctcagggaagggcatttcagcaagggggcacgccagaagaaagatctcaaagtaggagcatgcttttcctcactcaatgaacagcaggccggcggtggagtgggcacagagtgagcgaggagactggtatgagaccaaatcgcacagacaagacagtcaaatctacccaaccattgccaaagactttggctttcacttggagtgaggtaggcagcctttggagggttttagatgatgagcgatgtgatctaacgtaagtgttaggataatcactgtgtcagttcgcttgaggattgcatggagaatagactggagggggacaaagaccaaaggggtacagtggggagacaaatgaagcaagaagaatgaaaaaggataatggccaggaccaggttattagtggtgcaggcggtgggacatggttggattctgttatatcttgaaagtacagctgacggaatgtggattagtgaggaaaagatgagccaaggacaagttcattgtttttatcctgagcaactagaggaattgagtcctcgttaacagagatggaaaagaggaaaggagagcaggttttggagaggaagagcaagggtttgtttggggatatattaagtttcagatattttttaaatatctcacaggagttgtcaatatagcatgtagatttatgtatagagataaaggagaggtcattattatgcctgtaatggtatctcacaggaggtcattgttatgcctgtaatggtggtaccaaatcttttccaaaaggaccttgtctcatatcctctatttttcaaatgcagcataagtaatgagttatagaaaatcttccattaaaaacaattttatagtttggtcactttaaacggttaagctttgattatcaggattcctgaatctccaacaaatccagaagggtgaggaattattgccattatatcggcatatgtagtttggccattttgcatatccttccaatttaattttcaaaatgtagtcatgattcatcaaattttgactctccctgtttttaaaaaggtggtgtcgaccccacagagggcaacagcatgctcctccaccataaggcctgttttcactgtgggtgcacacaagagcttccctctttggccaacagatttgacagccagtaagagctcctcactgtgtatatctgtaaagttatctccagtcaacgctagggatgcacactctgcaacactctaggtggccttctgtatatatggcagaaaaagaaagtaaattttactctgtatctgcaagtgattttcaaaaccctcagtaatgagatccaactagcaaaaatttaccaggaactctctagaatataaatttagacatagttcctagctttggaatccatatttttcttcatcagcctctgagaaattgtggtctttgaggtcctactaagcagaatgcaacaaattttcgtggaactgtagagtatatcaatagaacctgaggaaaacaatgtttcaagttgttcatgtgacagtcaaaaagacagaaaacactgaattgtcaccatttgtgagactagcataatgctttcttccttcttatgtcagaagaaaatatcacatgtggctaggaagatcacaaagctagggagcattagcagagtgtgcaggaagattgtatgagaagattgaagaagagtaaaaaaggataatggctaggaccaggttatagtggtgcaggcggtgagatatggttggattctgttatatcttgaaagtacagctgacggaatctgacggaatatggattagtgaggcaaagatgagtcagggaacaacacagaaatgaggtaaacagggtctctgcccccaggccatacatagttgcaagaaaaaaggtttctctacccctagttccgaagcagccccatgtctaaattctgtaagtctttctgactctctgttttttcagtttcaagtgaaaataaattcctttgccaaaatcctgatgcatttatgatatcagagcaaaaagaaatatacaacatggcagatcttgtaaatagtgatcagatgttttactccaaaaggaatttttgtaagggcttatttagaagttaaaaacaagtcatccttgagttaaaaaaaaaagttactctcttataaagtgaaagttataataagaaaaatattggaagaaataagagcatgaatgatcaaaaatgtagaaagtaatttggtcttctgagaagaatgccttccattaatattaaattgtgtctgtctgtgtactaatgctctgttgaattgcacagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatggtaagatgttgctacaccttacactttgacttttctttctatttcaacaaactctctctcatttatcattagactttcctttgacctaataccacatgttcatgctgtatgctccataatttcttaattgagaaaacattatttaaccggtaaaatattgtcttgaaattctgtaagacaggagatgcttatgtatatatggaggcctgtggaaggaaaggaaaactatttctccattcattcttgctgtccagtttaactttagagcaaaattatagactggccacttagctgtctttggggatgtggataaaaatgggaaagtttgtgatccagtcaacagtgactatggccaaatattttcccatgatttcagttgctgctactcaaaggactcccactaaaacaaattcatacgtgtctataggaaaacagagggagggaatttgtctcttagaggtttcagaaggatgttttgttacatacctcagagaagaatcaagctgagattcttatgtaggcaattagagagcatggtaccagttgacctctgaatccctctcttccttaccaagcatatggaactcagcattttgataaatttcacatggcacataacaagaggaaaaacaggagtatcatgctgctcccaatataactaattctaaatctgtctaaccacagccacagccacagccacagccaagccaagcagtttctggccactcatcaggtgatgcccagcagcctggcacagatcactcccagaattttgagacaccaggacattcagtgagccactgaaaaagatgccaattttgtcattagaggaaagttaagtttggaggaaatttgagtagttacaatactgggctttgaggctctattttctgaatcattttaatttagatatctgttctgtaacttggtacaaataaaatgcctgattggatgctaagtcaaacaagactgtctaaatccaagctacaatcaaacattatttaacaacaggtactgaaataactactatgcagaaggcactgtgctaaatgcctgaggtggcggttctcaaagtgggagccacagacccttgagggtccctgagaccctttcagggagttcagtactattttcacaatacactaaaatattattttattaactatgttgaaatttaacttaatggcacaaaagcaatgctggaaacactgctggcaccttagcatgaagcaaggcagtaggatcaaattttactaatagtcatgcactcccaatgaagaaggaagaaaaagccagtttcacgtttgaagttcttgatgaagctgtaaaaattgttaattttactaaacctcgacctttgagtacatagcttattaatattctgtgtgacatatgggaattacacattaagcatgtctgctgcgtactgaggtattgtatttgtcttgaagaaaagcgcttaaatgactgagttgccagctgaactagttgcttttattgcttggagcaccatttttacttggaagagccattgataaactggcagatggttattcatatttgaattggcaaacatttgtcaaaaaagaatgaggcaagcttgtcgcttcaagaaaaacaactgacagtattttttgcaatggaaaaaatttgacttttcaaagcaattcattttgcctttttcgaaaatttgtgtctccaaccgtgagcttgatagtgttttaatatttgaagacttttcttgaagagattgatggtgatattaatgaaagtgactttttaattatattgtgtaataaaatgtatgaacatttagaaaaatctacaactcagttaaccaatattttccaaattactaatacatgatgtaatcaaatcatgcatggggaaatgatccattcaaagtactagatagaatcgtgaatttttttaatgatcaaaaatttttttgtatatttattgtgtacaacatatttttttgaaatatggatacattgtagaatggttctatcacactaagtaacatatgcattaccacacatacctttttttgtgtgttgagaacacttaaaatctactcagagattttcaaaatacaatacataagcattaactatagtcaccattttgcacaatagatttcttaaactcattcctactaactgaaaattttaattctttcatcaatatctccttaactctgcaccctgcccacaacccctgataaccaccattcaactctctgcttctgagttcaacttttttagattctgcatataagtgagattatgtggtatttgtttttctgtctctggatcatttttcttaatataatatcctccaggttcatccacattgtcacaagtgacaggatatccttctttttttaaggctgatagcattccattgtatatacctaccacattttctttatccacttatccattaatggaacataggtcgattctatttcttggctgttataagtaatgaacatgggagcccagatattctggctcaacatactgatttcattttccttggatatatacttagtagtggaataatataatggatcacatggtagttctatttttaatcttttgaggaagcttcatattattttccatagagggtatactaatttacactcccaccaatagtgtgcaagggttcccttttgtccacattctcaccaacacttgttatctcttctttttttgaaaatagccatcctaacatctttgtgcactctatgccttctgtgagctgatagctcattgtggtttaaatttacatttccctgatgattaaagatgtcaagcatttttcatatacctgttggccatttctatatcttctttttaaaaatttatattcaggtcctttgcccattttttaattgggttattttcttgttattgaattgttttagttccttatatatttcagatagtaacttcttatcagatgtatgcaaatattgtctcccattccatagagtgtctttttactctgttgattgtttccttggcagtgcagaagctttttagtttcatgtaatcccgtttatctatttccacttttgttgcctgttcccaatggagtcatatccaaaaaatcattgcccaaaccaatgtcatggagctttttcctatattttcttccagtagttgtacagtttcaggttttacatttaagtctttaatcgattttgagtttatttttgtatatgaggtaaaataagggtataatttcattcttctgcatatggatgtccaattttcccaacaacatttaaagacagagtcctttccttactgtgtattcttagcacctttgtgataaatcaatttactgtaaatgtgtggatttatttccgaacactttattcttttacattggtttatgtcatttttatgccagtaccatgctgttttgatgactatagctttgtattatgttttgaggttggtagagtgatgatttcatccttgttcttcttgttcaagattgctttggctattcatagtctattgcagttgcatacaaattttagaattgctttttctatttctgtgaaaaatgacattggaattttgataaggattgcattgaatctgtagattgctttaggtagcagggacattcgaacaatattaattcttctaatccatgaacatgggctatctgttcatttatttgtgttgtcttcatgttttacagttttcagtgttcagatctttcacctttttgtttaaatttatttctaggtcttttattttatttttatttttatagatattgtgaaagggatttctttatttctttctcagattgttccttattagtgtatagaaatgttactgatttttgtatgttgactttgtatcctgcagctttactgaatttgtttatctgttctagcaattttttgttgaagtctttagggttttctatatataaaatcatgtcatctgtaagcaaggacaatttaactttttccttctcaattttggatgccttttatttctctcttttgcttaattgctctgactaggattttgaatcgagtagaatagagtagaggagttacattgaataaaaatggcaagagtaggcatctttgtcttgttcctcatcttagaagaaaagctttccacatttcactgtttattatgatgtgagtttgttatatatggcctttattgtgttgaaatacattccttctatatctaattgttaagggtttttatcatgaaaggatattgaattttgacaagtgcttcttctgtatctgttgagatggttccatggttttcgtctcggttctgttaaagtgatgtattatgtttatgtatttgtgtgtgatgaaccatccttgcatccctggaataaatcctacttgatcatggagaatgttccttttagtgtgcttttgagttagtttcctagtattttgtttaagatttttacatctgtatttatcagagatattagcccataattttcttttcttgtagtgtcctttcatggtttgggtataagggtaatgctagcatcaagaaatagtttggtagtatccccttttcttccactttttggaaaagtttgagaaggattggtgttccggtgaagcttccagtgaaactgtcaggtcctggacttctctttgatgacagactttttattactgattcaatctccttacttattattggtttattagattttctatttcttcaagaaagtcttagtaggttgttgtgtgtaggaatttattcatttctcatgcatataatttttcagaatggtctcttatgaacatttgtatttctatggtattggttgtaatgtctcctccttcatttctgattttgtttttaatttgggctttctctttttttattatttagtctagctaaagattggttgattttgtttatcttttcaaaaaaacttgtttcattaatcttttctactgttttaatgtgctaactgaaaagcacattaaaaggatcattctccatgatcaagtaggatttatcccagggatgcaaggatggttcatcacacgcaaatacataaacataatacatcacattactagaaccaaaaacaaaattatggaaccatctcaatattttctattctctatttcatttatttctgttctgatctttattatttccttccttctatgaactttatgcttagtttattctttttctggtttcttcaggtaaaatgttaggttattcatttgagatctttgttttctgatggaggcatttattgccatgaacttccattgctcttagaacgacttttactgcattccttaaggtttgctatgttgtttccatttttgtctcaagatatttttgattttattttttactttttaactatttttttaggttcagagatacatgtgcacgtttgttatataggtaaattgcatgtcacaggggtttaccatacagattatttcatcaccaggtaataagcatagtacccagaaggtagttttttgatcttcaccttccttccacccactaccctccagtaggccccaatatctgtggtttcagtcttcgtgtccatgtgttctcaatgtttagctcctactaataagtgagaatatgtggtatttgttttcctgttcatgcattagtgtgcttagcataatggcctccagctccatccatgtgactgcagaggacatgatcttgttcctttttacgcctgagcagtattccatggtgtacatataccacatttcctttatccagtgtaccattttctttattccatgtctttgctattgtgaatagtgctatgatgaacacacgcatgcatgtgtctttatggtaaaatggtttatattccttcaggtatatacccaataacgggactgctgggtcaaatgacaattctcttttaagttctttgagaagttgctaaactgcttgccacaatggctgaactaatttgaattattaccagcaggatataagtgttcccttttctttgcaacctcaccagcatctgttattttttgactttttgataatagcctttctgactgctgtgatgtagtatctcattatggttttgatatgcctttctctctaattattagtaatgttgagcattttttcttacacttgttggctcatgtttgtgttcttttgaaaagtgtctgtttatgccttttgtccattttttaatgggactgtttgtttttggcttgttgatttaaagttccttatagattctggatattagacatttgtcagatgtatagtttgcaaatattttcagccattctgtagattatctgttttttcagttgtttcttttgctgtgcagaagctctttggtttaattagatcccatttgtcaatttttgtttttgttgcaattgtttttggcatctttgtcatgaaacctttgctaaggcctatgtccagaatggtatttcctaggttttcttctagggtttttatagtttggggttttgcatttaaacctttaatccatcttgagttgatagtcgtacatgttgaaaggaaggggtccagtttcaatcttctgcatataactagccagttacccagcaccatttattaaacagtgttttcctcatttcctgtttttgtcaactttgtcaaatattagttggttgcaggtatgaggctttattttggggttctctgttctgttccattgatctatgtgtcttcttttttaaccagtaccatactgttttgattcctgtagccttgtagtataatttgaagtcaggtaatgtgatgcccctgggtttattctttttagttaggattgctttgactatttgggctgttttttgcttccatatgaattttacaattgttttttctaaatctgtgaaaaattacattgataatttgataggcattgcattgaatgtgtagattggcttgggcagtatggtcatcttaacgatattgattcttctaatccataagcatggaatgtttttccatttgcgttatctgtcattttctttcatcagtgttttatagttctacttataaagatatttcacctcctttgttaaatgtattcctaggtttctgtgtgtgtgtgtggctataataggctatgttaacctgataacaatttaactttcttgcataaaaaactctacacttttactccacataccgcccccccaaacacattttaaatttttgatgtcacacttacatctttttatattgcatatttcttaacaaattattgtacctagtattatttttaataattttatcttttaaccttcattctaaaataaaagtgatttgcatattaccatgaaaatattagacaggtaatgtgatgcccctgggtttattcattttagttaggattgctttgccaattgggctgttttttgcttccatatgaattttacaattgttttttctaattctctgaaaaattacattgataatttgataggtattgcactgaatgtgtagattggcttgggcagtatggtcatcttaacaatattgattcttctaatccataagcatggaatgtttttccatttgcgttatctgtcattttctttcatcagtgttttatagttctacttataaagatatttcacctcctttgttaaatgtattcctaggtttctgtgtgtgtgtgtggctataataggctattttaacctgataacaatttaagtttcttgcataaaaaactctacacttttactccacatactccacacacacacacgttttaaattttcgatgtcacacttacatctttttatattgcatatttcttaacaaattattgtacctagtattatttttaataattttgtcttttaaccttcattctaaaaagtgatttgcatattaccatgaaaatattagactactttaaattggactgtgtacttacttttactagtgagttttatactttcatatgtttttatgttactcattagcctccttttctttcagctaaagacctccctttagcagttcttgtaagataggtctgttggtgaggaatggttaatttaaatataacaaagtacaaaaagttcatcagtagagtttcaggtttcatttttccactaacctgtaagaatttatcatttgagttttagtctattgttaaacagaaatgttcacaattatgtgaaaagtttattaaaatattcctcattttcctcattatttatctgtgtgaggccaggttttattcatttacgaaaatagcacattctaatagatttaattcagaagcagttataaaaatacagtcatcttcctttaagtctgacattaaataaatttgcaaaaatgtaaaacagtatcactcttctcactctcttttttgttgtttgggaaagtacaataatttttatgaaaatatattatttaacaaaatcaatttattattttcagtttaaaaataaggattttaaaattttttcatttcaatttctaatactgtaaatagtgataggtataacccaactaaaccaaactctttaagattctcaaatttttaagagtgtaaaggagtcctgaaataaaaaagttaaacaacctagaaaaaaacaaagatataaatcagcatgttagcattcatcaattcagttaccatcatttcatccctaaaagccatggcatatagttacgtctcactgagccaccactttgaaactcccaccctgtgccaggtacttgtgagcatgtaactttgttaatcaactgttcagggctatatcccaacatggctttgttgcacttttcgtggcacctctgctaaatctcgttaggtagaccaaaggggtcagttaactttttctttataccttttattcatgatatttataagtttggtaatttacaaaggtcttggacaaagaccaggggcttatatataataatttatttatctcttgaagaaacaaacaatataattggttatgaagcacaggcgtcataagcagaaaacaggtttataggtaaagggggaagacctagtgtgtgtcgcttgcatcaggaattcatgttaccatttggcaatatgaatttgcttagcagtgtgcttttttttctcccccccacaggatcttgctctgtccccaggctagagtacagtggcccaatctcggctcactgcaacctccacctccagagttcaagtgattctcgtgcctcagactcctgagtagctaggattacaggcgcaagccaccacacccagctaatacagctaatttttgtatttttagtagagacagggtttcatcatgttggccagactggtctcgaactcctgacctcaggtcatctgccaacctcggcctcccaaagtgctgggattataggcatgagccactgtgcctggctgccctttttagtaaatacattttgcatgaccatgtggttgtttacagctatttatctagtaaaccaataacttacagctttttaaaggcttaatgaatagcatggaattattcatgatatctgtgccatatcttgaggacccactgtatacctgatattgcactggactttggaaatgaaaaataatgagtgatcttggggaatttacaatgtaacatagaaaggtgtgtatcactaaatttgcacaatgaaacataattaataatagaagaagtatattatctggcagaatagagtggggaaaagtaccagcaaagacttagaataccagctctcctcaatacttgcacttagacttggatgagaaacagttccccgcacaggcagatgacagggttaggtatgataggagccacgtaagtaggagccactcgaaatctgagtttggtgtggctggtgtggagggttgagggaatatgaagagaggaccacaacttgaatcactgagggcccttttttgatcctattagtgaaatctttaaagaaattgtattggtgacaataacagagaaataagggctttgaggatgaaaacataggctttaaaaaaaaaacttaagaaaaaaataataaagtaagttcagtattcagtgtcctgccttaaagaaagcattttaggcatgcaaatatcccatatattcagaggcttctataaaaaatacaaacaaaccctgtcatatacacatgaggcaaaaaaagatactttgtgagtagaaactattgaggtaaaagaaaaacttgttttagaagctgaaggcccagctgctgacttaataaaacaaattatgagaattttgtttatgcgaaaatccatgctgttgaaaacgcgagtgtttaaagttttctataaacaggaacaaggtgttctaccaaaaaaaagtataaaagcacattgaataactgctttgagtatttgacttggaggaaactaccatcactagttgagtatacctctttgatagcaatatgtgttaaaagtctaacagtctcactctacccctccccgagaaggtaaaggaatatcctgaccttaagggttgtgagacctagatgtttcttaccaaagaactccggtgacttttctttgcagattttaaatagcaaactattttatggtggctttaagccttccagagcaagcagattaggtatgtagttccttttaataaaagtatttggaagttcaataaaggcaattatgatttttctaggaccttttccaattctgtgattatgtgaatgactacccggaatttccatcaaacactgatatacaacttgctatggctacaatttattttggtgtgaaaacatgtttgcttttctgttcttatgtctcccttcatacaaaagtataatatcccagatatgtaggcatatagttctgccattcagagtaattctaatatactttaatcttattaactatctggaagactaatgcacagttatagctgcatttctttaagcaagtctatcatatctttgggtttatgccaaactaaatttgtgaactattatccatttacaaaatgattatttacatcaatcttcctttaaataacaaatgctcacaatgcattttaaaatattacctactttataaaaatccattctgaataaaaatgggagaatacctgtagtgttcattgcattgagttgttgactctttggccaatatgcgtttatattttgtcttgaaagatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaaggtaaaagaaataaaagattaaaatagtagctaacctggcttttgtcaatataacagttgattcacccctgcactggtagtgtgttgtccaaatcaaaatatattaacatcagatatcaggatgagagaccttgagctcactatctgtaacagatattgttcattgcaaaagcagaaggaagatttagtttccaaatttttcattcaggagaagtccggggggcaggtggaagtttagagacaggaatttggtggcaatctccggatggtagaattcagatgattcttttctttatatatttttatatttctgaaattttctatagtaagtttgttttgaatttataatcaggaaaaaaagctgtactgatggttagggaagaaagtatgtatctatatggatggatagatatgtgacatctaagaggaaacccaatattgagtcagcataggtagtcaacagcaggtgcatacggttttagaaagcggaggtgtggcttttacctagaggaatgcctaataagtagtgtggcagtcatacttaaaggagacgtggaacatttgaaaaccctatgtaggagaatcacaacaatgattaaagtttttaaaaatgggacctatgaatttagaataaaagaattaaaacttttagatacagaaataaagaaaactgattaatgatgagcagaaagtatagagtattattattctcaaatgggaaatggctctattccatcttcattgaaaacagaagtttacagggctatatgtttgttaatgaaacaaccacaagctacatagaaaataaatttatatttctgtatttactatacaggtagaatctcatgatactaaatagcattaggatgaaaatttctatagcaccattttctctatactctagttaactgaattcttgtttccaaactatttgatattatgcaattctggccttaaaagtacaatagctatacacccttaagcttagtgtagtggcatttaattcacttaacatatattttttaaactgccttttccttctgttactaacaaaaaagaagctctaactttatgttattttcctgaatatgtcattgatatgaaattatagacactacaagacaaaaaatgattttttctcccccaccaattctttaaaatgcttataatatctccctaggggattttaataactttttaaataagaaaagactatttcagcataaagacctacattttaaatggcaatgttaaggtaaatttcatctgtcatttttataaaaaagtggttagcctctgcctctgtggtaagaatactgggtaccaactgcaaagtagctggcaggtactcaatcttaaggaatgaaatagaagttttacaaacaggttcccccaagtctcatacaaagtatactaaaacctgaagatgggagcctcagtagtgatctttctgtcaattttatgtatataatatacatgagatatatttattatattttaataatttaatttattgatataaatacgtatatttatagctgtaaaatatatgttatttgtgtctaagaagtttctgtcatgatttatcaataaaaactctgccttcatctttttgataaatcttcaatctggaaactaagaaaatcaccacacttaaaaaaaaatagaaaagaaaccgagtgggcattatttaggtagtgtgttaataagcaacacttttttactgaagctgaaacctttatgatactccctggacacatagtatgcttaaagcagattgtttgttttcataaaacacacattgattttgaactatatgctgtttctttattttgaagtttttttttaatgtgaggagatttgaaaagtggacagagatgttcataaaacagaaaaaaactaagtcgttgcattctgtttcagtggttatcaagagaaatcactgactttattagatgaatacaaattatgaattttttgtgaaaagggaaagggaaatgtaaactgtgcttcaactattcgtaattctgaaagcgaaatattcttgtgtgtttcagatttctactttccatggctcttaattattatctttggaatatttgggctaacagtgatgctatttgtattcttattttctaaacagcaaaggtaggtgtggagtagtattctttggtattttgtaccagttgtttagatttccatatgtgtttctatttgttatttgatattttctttgtcaaattatgagtggaaattttagttaacctagtacacttttatctccagttatatatttaccattcatataaaactcaatttgttgtatttatcttagacaatttagaggtttagattctatctggagacttgtacaggacattaagaggcttaggctggtgactatgcataccttgtgatatgtacctctttatccaagagctagctctttccctcaagtcctcaacaagttgacccattcattccaggacttcaaagtatcactgagcctttggctgagtctgatacagtccttatatacagacaatttttttttttccttgagacggagtcttactctgttgcccaggctggagtgcaatggcgcaatcttggctcactgcaaccgccgccccccaggttcaagcaattctcctgcctcagcctccagagtagctgggattacaggcatgcgccaccaagcccagctaattttgtatttttagatacagtttcaccatgttggtcagactggtctcgaactcctgacctcaggtgatctgcccacctcagcctcccaaagcgctgggattacaggcgtgagctaccgcgcctggccccatttaaggtatttttaaagtcccaatggttaatcttgttgcttctcctagaattaaggtgactaacactcccaggttgcctagaactctcctggtttttagcaatgcaagtccggtgtgccaggaaatccctcagttccaggtaaccaagacagttgatccccttacctagaattgaaaatacgttctccagctgaagccaagaggcatctataaatcaaaatgagatctatgttaatatattttaaaagattttactttgttttgtaaggtagtatagcacttgtaaacttcaaaacagaattttgttaggaagaagaattattgggacgctagatttctatagtgtcaagcatgctaaaagtctaactgaatgcagaaagggttattttcagtagagcttcatgtccaattttataatataaaccaattggaaagtaaaattcattctgaattccattttgcacctaactttctggcaacattcctgttttccaaaaaagcagctatcataaatcacaacacaattttctattgtttcaggaaaataaataaatatatttttagaattttaatttgtgtatttaagtaatgccaacaacaaaaaagccaaattattctgttgattaatttcagtttattaatctatatatttggtgggaaaatttatacataacttcagtagataaactcacgaggtatgtaaagtaattagctcttagtattagctgtgaatttctagccattgtgaaggccaagtcaatttgttatgttgtttagttatattagttaacaatattaggaagaaaaaattatcctctcaaaaagtaggatttccaagaaaacatattacttctaatacagtgctttttataaataatgaaatgcttaactataatgtttagtcaaaatcaccaaattctacaattgatttgaaatctttattgttctcccaaatttcctgcactaaattgaattttctgtaggaaagaattaactttattttttatttgcccattaaaaacgcttatcattgtctaaatttgcatgttctactgaaagtgggaaatagtagcaaatatttgtcagcaagtatggacagaacatgtagttccaacaattaaattgatactgcaaagaacgagatttttcctagaactgtagggctgtaaagtggcgtcaggtcctacatgcctttgaaattttctgagtccacaattcattatccaacccacttcaccctgctttaatccagttaattgagtcaactctagcaaaatttataattttatttgtatctgatacaaaaccacaaacatagtttcaagtcaggctattattatactggttcctaccacacaaccctcccagcctttgagctgttaccaattgaggaaagaaataactgaatcagcctaaaatagaatttccaaaccagtagcgaaattcagcctacagattcatattttgttattttattttaattagttttgatttcagagtgaagattttcctacaaagtgtttgtaaaatagagaattttcacacaaaaatccagatttggggattatcttttaaaaaatgaaagatgtagtgaaactaaacaaggcagcatatgctgcagcagacaaccagctatcctatttgggattggctcacattctttaatttgccaccatcctcattcctcctaatgactttgcaactggcttgctttattcctctgcatgacctgcttgggcctcttagatttatgctctgccactgtggcataaggtcactacaaccactagaaaaccactagcgcatgcctgaatgcatcatcctatttaaaaaggaaaagcacacgtcacaaagtcaaacatcagccatttggaaacctttgcttcctgtaattagaattatgttccatctttttatgtttttgggaatttgaaataccaatttcgagatgcagaatcaaaaaaaaaaaaacaaaacagcgaaacagcagcatgacacaaagaacctgggttttgatttggagtcaggttctctgggtttgagccccaactgtgccaactatgaatgcatgatttgaacatgttgcttaattttccaagtttttgcacagatatatcatctgcctccctgggagtcataaggattaagtgaaatgtttagtgcaggggtcacaaacttatttcatagagttagagtacatttttaggcttttcaagccatacagtctctatcacagctactcaactctgccactgtagcacgaaagtggccataaacaaaatggaaatgaatgaagatgcttgtgttctcataaaattttatctacacaaacatgtgacaggccagatttggcccacagaccttaatttagtgacccatagtttagtgcaaagtatatcccacagtgtctgatttatcagaagcactaaaaaatgatagtagttattattaataatttgtattacttatttctatatctgtaattcatcagtaacaatatgctttaacatttgccccactgagtagtagaggctacttaatgcaatttataaaatggatttttgcttattacttggattaggtaaaatagcaagtggaaatactgagaaaatgtactccttatggaatggactggactgaccattcacactgagtggaatagtaactgatatccaaaaatctggttaccacctcttcatgacagtgtcatctctgaatagtcaggagttttttaaaaaattaaatgaattgtttggaataatctctgagcctttttccagtgctataatttgattttaaaaaataaactccaggccagatacaatggcttatagcatataaatccagcactttgggaggatggggcgggagtattgccctgaggccaggagttccagacagctcgggcaatgactagagcaagactccattacaaaaaatgaaacaacaaaaattagcacaccctgtagtcctagctacttaggaggctgaggcaagaatatcgcttggcccaggagtttgaggctgcagtgaattatgattgcaccactggactccagtgtgggcaatgaagtaagaccctgtctcaaaaagttttaaaaaaaattaaaaacaccataaattccaattacactattaattgtacaaaatagatacatgatttattcatttttatgaccaaaaaataatttaaagatttggaacaaaaaatgtaagtgcatcctagaattgtatatataaacccatactgattagttagagatagttaaaatttaatctgtcccatctgaaatgaaccctgtagtaaaaccctggttaataagatcatcttagataatttcataattaatatgaactatatggctaacctacccaagtctaccctttttcaagggtgtaagtaatcttggctccatgtggattgactcttttttctttctttcctgtacaaattactgatgagatgtacactagaattgccttatagctgaaatggaaatcagctttagatgaaattaaatttctttctttcaaatactaaatctggctgaaaataaaaagcattaagaaaaaaacaattgtgggaaaaccacattttcttttaatagacttcagatgaggctttttgggttttttagttgttcttttttttccttctacagtttttctttctcatttactgtctaatattttcttctgtttctcacactccaattatataaagtaccagaatatttggaaaaagtaatagtattgccaatattttatttctatcttttgctataattgagaatatgtagcttttaagatgtcaaaaccaaaattttatatgttttcaaggattaaaatgctgattctgcccccagttccagttccaaagattaaaggaatcgatccagatctcctcaaggtaactaataattttatctaaattgtagctagtactaattaacacctgaagactcctgtcatatgttgaaggttttctgtaagctatatatatcacattcaattttcttgtgtctcttctcctggagaaaatttttttaaatattctatttcttaaaaataagaaaacgtcatatgtatttaaaaagttacacactaatttatgtttttttatatgttttgttactgttgttcttattgtaaccataattaatctctgaacattatttgctaattcatttaattattatgagtttcttttcatagatcttcattttctttctattttctaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaaccactctgtatactgtgaattatcattgtaaggagagcttagcaccactggatcaaatacatcagcattgggtatggagatttttatgtgctgagatatagagagggaaacatatcccccttcccttattttttgagaagacaaaagcccaactcagaaatatcccactggcttggccctccccttaggctgtgactccccataggcaaaggttcatagagctgtgtatttgatgcatcatggaaaataaatgacatgggtgttggatgagggagagtgatatgtgagcattatctttacatttccagcttgagcatgttgtctggaaggaaggaaagcagctcttcctctgccattcacccattggcctaagtcagtttattggactagctgcttgttatcatgggaatcagctaataagtcaggcttgggaggaaggctgattaggtaagttgtgtaggagcctgagagagccatgaagtttagattcctacagcaggaggcaggatgcaggtgaggtagctgctgaaccctaggctcctgagcaggcactggattctgagatgtaggaatctggtgaggacattgataaacctactaaacaatgacgtattgcttcagcaagtcaaatgcaaagtgccacaactttttataatactcaagtgttatgttaaaaaaaaaaaatgtcttcacctgctgccctctgccctgtgagcagccattacctgaaagaaccatggagtgaagcctcagggcttcttcatatagatgctttaagatatgaggagtacagggaaaagaaagcctgcctacttccatggattgaaataacacaattctatttcagaagattaatggtgtgttgaaaatggctacacacatctttcagcatttcaatttctcaaagtttctactaacactttattcaagtgctataatatttacatatttacatatttgtataccaaaatatgtcttgttatgtgcttgttttagggtaagaaatagtgaccagaaaaaccagaagttacttaaatctaaactttttagtttggaatccaagatcccacataatttgccccagtctcctttgagagtttaaaatttaagacctagatgtaaagggcacagcttctgaataagaatttgatgtttggttaacattcaaactctattgctgtggaaatctaatgagcatatgatgtcagctatgttacacgggaaacattgctcatagtttaaatgatctctgactgataaatgacatctggatagggagaaactataaccacctggagataagttatactttggacttgagtgtagtgacttgtaattaagcatttcccctatagaaactctggaagctatgtttctggagatgtaacaagagtaactggctccagtgaggcatagagcttctaagcctgggagactcctttacctgcccaataccttctctgaatctgagctgccagttgtaggaggagaggaaggaaaagaccttctggatagctatataaacagctgtttagattgcttcatgcactgttatcattactgtgactctaaagcagaaagcctgatgctgtatcccttctgtcctacatccctctgagtagactggaaccaagtatggtgaatctggggaatgtgtggttgagcctaagaagatccccttgcatatgtagcaaaagacacttgccatttcttgaacaaagtttgtgctttcccatctctatgttcttggtcatgcctcctccttcaactaaaaagctcccacttaccaaccctgcctgtcaagattcccttcatccttcatggcccagctctaatgcctccttcatgaactctcctctgattcccaccatccaatcagtgattttttcttctgaaccatgtttaatggtgtttatcacattactttggtagctcacctgacaaacggctagtatagatttaccagtatgtacgctggtgaatatctatctccaaaatgcccttgaatggataattttgtggt

SEQ ID NO: 3 - DNA, 4414 bp, homo sapien
ccgcgctctctgatcagaggcgaagctcggaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttactttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgagtctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgataatgtgcttctgttatcaaacaccaacataaaaatgatctaaacc

SEQ ID NO: 4 - DNA, 459 bp, homo sapien
  misc_feature (342)..(342): n is a, c, g, or t
tgtaatacgactactatagggcggccgcgaattcggcacgagcggcggcggcggcagcggcagcagcggctgctacagtggcggtggcggcggcggctgctgctgagcccgggcggcggcggggaccccgggctggggccacgcgggccggaggccccggcaccattggccccagcgcagacgcgaacccgcgctctctgatcagaggcgaagctcggaggtcctacaggtatggatctctggcagctgctgttgaccttggcactggcaggatcaagtgatgctttttctggaagtgaggccacagcagctatccttagcagagcaccctggagtctgcanagtgttaatccaggcctaaagacaaattcttctaaggagcctaaattcaccaagtgccgttcacctgagcgagagaacttttcatgccactggacagatgaagttcatcatggtaca

SEQ ID NO: 5 - DNA, 569 bp, homo sapien
  misc_feature (148)..(148): n is a, c, g, or t
gttttgtgcgggccgcagccgcacgttggcaccgatggaactggggtcagtagagtgacagccaccagtccgcatgaactggggtcctacaggtatggatctctggcagctgctgttgaccttggcactggcaggatcaagtgatgcntttttctggaagtgaggccacagcagctatccttagcagagcaccctggagtctgcaaagtgttaatccaggcctaaagacaagatggggtccatgctcacatatcaagaaaatggagtcttacatgcaagcctaatgcagagtagagaagctcaccaacttgaaggaagcatgaatgaaattacaaggaaatctagcttagaaaaattaaccctgtagcttggtttttccactctttgctcttggcaaaaggatcttacgggaaaactggagcttagagaacttatgtaacattactagcaagttgcacagctgggattcaaactgaaatccagctagcttcaaagactgtgttctttctgctgctgcatactacccctacctaccaaggctctgagattagaaagcaggatgggtgtgt

SEQ ID NO: 6 - DNA, 421 bp, homo sapien
gcgcgtgaacacagcgcgcagagcgcgcggtcttttgcgcgtttgtgcgggccgcagccgcacgttggcaccgatggaactggggtcagtagagtgacagccaccagtccgcatgaactgggttaaaatgagcaacttctttaaccagaactgaccttgaagacaaatggctaaaataaaacatttgctgaattcactgggcgcatcttacaagtaatttttggattctgcattgactacctacaagtgccttctgggtgcaagtccacaggcaagatttgttctgcaaatcttccatgaccaaggtcacctctttggattggcagacccagggagtccatattgggaagataaattcacacttcaccccttgttgagatctccagccttgctcctctgataaccaggtcctacaggtatg

SEQ ID NO: 7 - DNA, 434 bp, homo sapien
tgagatctccatccagccttgctcctctgataaccagtttttggcatctcagatgaggaagagtgatgggcgacaggtgatggtgacaactattaataagatctgaaagtaaacagtctcatgaaaggtggccaggagagggcagtcaccttttatcaggagcacagactgaatttgcaaagggtcctacaggtatggatctctggcagctgctgttgaccttggcactggcaggatcaagtgatgctttttctggaagtgaggctctgaaatacctacttccaagagaacgaaatttattcaagaaatgttggatggaaattgaagagtgagcttggaaacgagacacagagtggcaggagcccagaccaacctgtttatgaaagatgcctttgcccatagagggaaaaatacaccttaaaacctcaaaaaaa

SEQ ID NO: 8 - DNA, 2177 bp, homo sapien
cgaagctcggaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaagaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaagggtggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcctccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatgactatgtttttaatgtatagtaaatcacgctttttgaaaaagcgaaaaaatcaggtggcttttgcggt

SEQ ID NO: 9 - DNA, 4529 bp, homo sapien
ggagagactggggaggtcgagctgtgcgcgtggacacagcgcgcagagcgcgcggtcttttgcgcgtttgtgcgggccgcagccgcacgttggcaccgatggaactggggtcagtagagtgacagccaccagtccgcatgaactggggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 10 - DNA, 4814 bp, homo sapien
ggagagactggggaggtcgagctgtgcgcgtggacacagcgcgcagagcgcgcggtcttttgcgcgtttgtgcgggccgcagccgcacgttggcaccgatggaactggggtcagtagagtgacagccaccagtccgcatgaactgggttaaaatgagcaacttctttaaccagaactgaccttgaagacaaatggctaaaataaaacatttgctgaattcactgggcgcatcttacaagtaatttttggattctgcattgactacctacaagtgccttctgggtgcaagtccacaggcaagatttgttctgcaaatcttccatgaccaaggtcacctctttggattggcagacccagggagtccatattgggaagataaattcacacttcaccccttgttgagatctccagccttgctcctctgataaccaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 11 - DNA, 4522 bp, homo sapien
gcctgtctgtttgtgccgccaggagaccttggaagggacagagaaagagctggggttttgccatgttgcccaggctgatctccaacacctgggatcaagcagtctgcccaccttggcctcccaaagtgctgaaattacaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 12 - DNA, 4491 bp, homo sapien
cctcttctcagctgatttggctgcctccattgtaataggcctcatgagactccagcctaggcctggccttcagttcagcaggcagagcccagagatgtactgggcaaaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 13 - DNA, 4698 bp, homo sapien
gatatgtgtgtgtgtgcatgagagagagagattgagaatgactgatttgggagggattttgtgaaggtttatatatcaaagcagaaagaccaagaatttagagattaatacatgccaagtggtaaccaagaaacttctgtgggatcccacctccaacccctccctctctgtcagattttaaccaaatcagtgtgatgtgatctgcttgcatatatgagtgaaagaaaaaggaaatttaaaaagttcttgatataaagcctggaggaaacaatacgaaaatccagcctctatttcagcaatatctgccggactattggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 14 - DNA, 4524 bp, homo sapien
ggggaatgagtagcaaagatggattaagtgagaagagtataggaggcagcagggccagaggtgtgaatagcccagaaccttctgagaagattcctttgtggacggaagaaaggggaggtttgtggaaatggtggaagataaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 15 - DNA, 4419 bp, homo sapien
caatgatattagctatgacagcacgtatgagcctggggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 16 - DNA, 4785 bp, homo sapien
cctgtccagctcaaggccccatgctttctgatactgctgataaggttttctatttccagatcaaattaaagcaaaccttactggccctgttactgaagctgtgcatgggggtcgtttgctgtgaggtgtttctatggctttgagccagggtatgaacatctctagtgttcatgttatttcctgagactagcactcacgggaagtagaatttattacaacctgctgtttgagttcatgaaaagtaggacaatatgagactctggggcagtgaaagacttaccaggattccttctggaactgactcgtcagctcattcatgtcttacccagtctttaaacagtatttcatgataatggtctgcttttaattgctgggctttaccttaccctttttgtgattgcaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 17 - DNA, 4316 bp, homo sapien
gtcctacaggtatggatctctggcagctgctgttgaccttggcactggcaggatcaagtgatgctttttctggaagtgaggattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 18 - DNA, 4356 bp, homo sapien
gtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 19 - DNA, 4312 bp, homo sapien
gtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 20 - DNA, 20 bp, Artificial sequence
  Synthetic oligonucleotide
acctccgagcttcgcctctg

SEQ ID NO: 21 - DNA, 20 bp, Artificial sequence
  Synthetic oligonucleotide
ctgtaggacctccgagcttc

SEQ ID NO: 22 - DNA, 20 bp, Artificial sequence
  Synthetic oligonucleotide
tccatacctgtaggacctcc

SEQ ID NO: 23 - DNA, 20 bp, Artificial sequence
  Synthetic oligonucleotide
tgccaaggtcaacagcagct

SEQ ID NO: 24 - DNA, 20 bp, Artificial sequence
  Synthetic oligonucleotide
ctgccagtgccaaggtcaac

SEQ ID NO: 25 - DNA, 20 bp, Artificial sequence
  Synthetic oligonucleotide
cttgatcctgccagtgccaa

SEQ ID NO: 26 - DNA, 20 bp, Artificial sequence
  Synthetic oligonucleotide
agcatcacttgatcctgcca

SEQ ID NO: 27 - DNA, 20 bp, Artificial sequence
  Synthetic oligonucleotide
cagaaaaagcatcacttgat

SEQ ID NO: 28 - DNA, 20 bp, Artificial sequence
  Synthetic oligonucleotide
tcacttccagaaaaagcatc

SEQ ID NO: 29 - DNA, 20 bp, Artificial sequence
  Synthetic oligonucleotide
gtctctcgctcaggtgaacg

SEQ ID NO: 30 - DNA, 20 bp, Artificial sequence
  Synthetic oligonucleotide
tgaaaaagtctctcgctcag

SEQ ID NO: 31 - DNA, 20 bp, Artificial sequence
  Synthetic oligonucleotide
agtggcatgaaaaagtctct

SEQ ID NO: 32 - DNA, 20 bp, Artificial sequence
  Synthetic oligonucleotide
tctgtccagtggcatgaaaa

SEQ ID NO: 33 - DNA, 20 bp, Artificial sequence
  Synthetic oligonucleotide
ggatctggttgcactatttc

SEQ ID NO: 34 - DNA, 20 bp, Artificial sequence
  Synthetic oligonucleotide
aatgggtggatctggttgca

SEQ ID NO: 35 - DNA, 20 bp, Artificial sequence
  Synthetic oligonucleotide
agtccagttgagggcaatgg

SEQ ID NO: 36 - DNA, 20 bp, Artificial sequence
  Synthetic oligonucleotide
tcagtaaagtccagttgagg

SEQ ID NO: 37 - DNA, 20 bp, Artificial sequence
  Synthetic oligonucleotide
gaatcccagttaaactgacg

SEQ ID NO: 38 - DNA, 20 bp, Artificial sequence
  Synthetic oligonucleotide
tctgcatgaatcccagttaa

SEQ ID NO: 39 - DNA, 20 bp, Artificial sequence
  Synthetic oligonucleotide
atccatcctttctgaatatc

SEQ ID NO: 40 - DNA, 20 bp, Artificial sequence
  Synthetic oligonucleotide
cagaaccatccatcctttct

SEQ ID NO: 41 - DNA, 20 bp, Artificial sequence
  Synthetic oligonucleotide
catactccagaaccatccat

SEQ ID NO: 42 - DNA, 20 bp, Artificial sequence
  Synthetic oligonucleotide
tgaagttcatactccagaac

SEQ ID NO: 43 - DNA, 20 bp, Artificial sequence
  Synthetic oligonucleotide
tttgtattgaagttcatact

SEQ ID NO: 44 - DNA, 20 bp, Artificial sequence
  Synthetic oligonucleotide
ttacttctttgtattgaagt

SEQ ID NO: 45 - DNA, 20 bp, Artificial sequence
  Synthetic oligonucleotide
gtttcatttacttctttgta

SEQ ID NO: 46 - DNA, 20 bp, Artificial sequence
  Synthetic oligonucleotide
ccatttagtttcatttactt

SEQ ID NO: 47 - DNA, 20 bp, Artificial sequence
  Synthetic oligonucleotide
tcattttccatttagtttca

SEQ ID NO: 48 - DNA, 20 bp, Artificial sequence
  Synthetic oligonucleotide
acacgcacttcatattcctt

SEQ ID NO: 49 - DNA, 20 bp, Artificial sequence
  Synthetic oligonucleotide
ggatctcacacgcacttcat

SEQ ID NO: 50 - DNA, 20 bp, Artificial sequence
  Synthetic oligonucleotide
aagtgttacatagagcacct

SEQ ID NO: 51 - DNA, 20 bp, Artificial sequence
  Synthetic oligonucleotide
tctgaggaagtgttacatag

SEQ ID NO: 52 - DNA, 20 bp, Artificial sequence
  Synthetic oligonucleotide
cttcttcacatgtaaattgg

SEQ ID NO: 53 - DNA, 20 bp, Artificial sequence
  Synthetic oligonucleotide
tagaaatcttcttcacatgt

SEQ ID NO: 54 - DNA, 20 bp, Artificial sequence
  Synthetic oligonucleotide
tggaaagtagaaatcttctt

SEQ ID NO: 55 - DNA, 20 bp, Artificial sequence
  Synthetic oligonucleotide
agagccatggaaagtagaaa

SEQ ID NO: 56 - DNA, 20 bp, Artificial sequence
  Synthetic oligonucleotide
ataattaagagccatggaaa

SEQ ID NO: 57 - DNA, 20 bp, Artificial sequence
  Synthetic oligonucleotide
cagttggtctgtgctcacat

SEQ ID NO: 58 - DNA, 20 bp, Artificial sequence
  Synthetic oligonucleotide
gtgccaaggtcaacagcagc

SEQ ID NO: 59 - DNA, 20 bp, Artificial sequence
  Synthetic oligonucleotide
agtgccaaggtcaacagcag

SEQ ID NO: 60 - DNA, 20 bp, Artificial sequence
  Synthetic oligonucleotide
catcacttgatcctgccagt

SEQ ID NO: 61 - DNA, 20 bp, Artificial sequence
  Synthetic oligonucleotide
gcatcacttgatcctgccag

SEQ ID NO: 62 - DNA, 20 bp, Artificial sequence
  Synthetic oligonucleotide
aagcatcacttgatcctgcc

SEQ ID NO: 63 - DNA, 20 bp, Artificial sequence
  Synthetic oligonucleotide
aaagcatcacttgatcctgc

SEQ ID NO: 64 - DNA, 20 bp, Artificial sequence
  Synthetic oligonucleotide
atctcacacgcacttcatat

SEQ ID NO: 65 - DNA, 20 bp, Artificial sequence
  Synthetic oligonucleotide
gatctcacacgcacttcata

SEQ ID NO: 66 - DNA, 20 bp, Artificial sequence
  Synthetic oligonucleotide
tggatctcacacgcacttca

SEQ ID NO: 67 - DNA, 20 bp, Artificial sequence
  Synthetic oligonucleotide
ttggatctcacacgcacttc

SEQ ID NO: 68 - DNA, 20 bp, Artificial sequence
  Synthetic oligonucleotide
tccagaatgtcaggttcaca

SEQ ID NO: 69 - DNA, 20 bp, Artificial sequence
  Synthetic oligonucleotide
ctccagaatgtcaggttcac

SEQ ID NO: 70 - DNA, 20 bp, Artificial sequence
  Synthetic oligonucleotide
gtctccagaatgtcaggttc

SEQ ID NO: 71 - DNA, 20 bp, Artificial sequence
  Synthetic oligonucleotide
agtctccagaatgtcaggtt

SEQ ID NO: 72 - DNA, 20 bp, Artificial sequence
  Synthetic oligonucleotide
gcttggataacactgggctg

SEQ ID NO: 73 - DNA, 20 bp, Artificial sequence
  Synthetic oligonucleotide
tgcttggataacactgggct

SEQ ID NO: 74 - DNA, 20 bp, Artificial sequence
  Synthetic oligonucleotide
tctgcttggataacactggg

SEQ ID NO: 75 - DNA, 20 bp, Artificial sequence
  Synthetic oligonucleotide
ctctgcttggataacactgg

SEQ ID NO: 76 - DNA, 20 bp, Artificial sequence
  Synthetic oligonucleotide
tctctgcttggataacactg

SEQ ID NO: 77 - DNA, 20 bp, Artificial sequence
  Synthetic oligonucleotide
cagagtgagaccatttccgg

SEQ ID NO: 78 - DNA, 20 bp, Artificial sequence
  Synthetic oligonucleotide
gcagagtgagaccatttccg

SEQ ID NO: 79 - DNA, 20 bp, Artificial sequence
  Synthetic oligonucleotide
tggcagagtgagaccatttc

SEQ ID NO: 80 - DNA, 20 bp, Artificial sequence
  Synthetic oligonucleotide
ttggcagagtgagaccattt

SEQ ID NO: 81 - DNA, 20 bp, Artificial sequence
  Synthetic oligonucleotide
cttggcagagtgagaccatt

SEQ ID NO: 82 - DNA, 20 bp, Artificial sequence
  Synthetic oligonucleotide
cagtgtgtagtgtaatataa

SEQ ID NO: 83 - DNA, 20 bp, Artificial sequence
  Synthetic oligonucleotide
acagtgtgtagtgtaatata

SEQ ID NO: 84 - DNA, 20 bp, Artificial sequence
  Synthetic oligonucleotide
acacagtgtgtagtgtaata

SEQ ID NO: 85 - DNA, 20 bp, Artificial sequence
  Synthetic oligonucleotide
tacacagtgtgtagtgtaat

SEQ ID NO: 86 - DNA, 20 bp, Artificial sequence
  Synthetic oligonucleotide
gtacacagtgtgtagtgtaa

SEQ ID NO: 87 - DNA, 20 bp, Artificial sequence
  Synthetic oligonucleotide
tgtaccttattcccttcctg

SEQ ID NO: 88 - DNA, 20 bp, Artificial sequence
  Synthetic oligonucleotide
ttgtaccttattcccttcct

SEQ ID NO: 89 - DNA, 20 bp, Artificial sequence
  Synthetic oligonucleotide
tcttgtaccttattcccttc

SEQ ID NO: 90 - DNA, 20 bp, Artificial sequence
  Synthetic oligonucleotide
ttcttgtaccttattccctt

SEQ ID NO: 91 - DNA, 20 bp, Artificial sequence
  Synthetic oligonucleotide
acatgtacccaaaccaacac

SEQ ID NO: 92 - DNA, 20 bp, Artificial sequence
  Synthetic oligonucleotide
cttcttgtaccttattccct

SEQ ID NO: 93 - DNA, 20 bp, Artificial sequence
  Synthetic oligonucleotide
tgcttcttgtaccttattcc

SEQ ID NO: 94 - DNA, 20 bp, Artificial sequence
  Synthetic oligonucleotide
atgcttcttgtaccttattc

SEQ ID NO: 95 - DNA, 20 bp, Artificial sequence
  Synthetic oligonucleotide
aaatgcttcttgtaccttat

SEQ ID NO: 96 - DNA, 20 bp, Artificial sequence
  Synthetic oligonucleotide
aaaatgcttcttgtacctta

SEQ ID NO: 97 - DNA, 20 bp, Artificial sequence
  Synthetic oligonucleotide
caaaatgcttcttgtacctt

SEQ ID NO: 98 - DNA, 20 bp, Artificial sequence
  Synthetic oligonucleotide
cttctgaatgcttgctttga

SEQ ID NO: 99 - DNA, 20 bp, Artificial sequence
  Synthetic oligonucleotide
tcttctgaatgcttgctttg

SEQ ID NO: 100 - DNA, 20 bp, Artificial sequence
  Synthetic oligonucleotide
tttcttctgaatgcttgctt

SEQ ID NO: 101 - DNA, 20 bp, Artificial sequence
  Synthetic oligonucleotide
ttttcttctgaatgcttgct

SEQ ID NO: 102 - DNA, 20 bp, Artificial sequence
  Synthetic oligonucleotide
tttttcttctgaatgcttgc

SEQ ID NO: 103 - DNA, 20 bp, Artificial sequence
  Synthetic oligonucleotide
tgcgataaatgggaaatact

SEQ ID NO: 104 - DNA, 20 bp, Artificial sequence
  Synthetic oligonucleotide
ctgcgataaatgggaaatac

SEQ ID NO: 105 - DNA, 20 bp, Artificial sequence
  Synthetic oligonucleotide
tctgcgataaatgggaaata

SEQ ID NO: 106 - DNA, 20 bp, Artificial sequence
  Synthetic oligonucleotide
ggtctgcgataaatgggaaa

SEQ ID NO: 107 - DNA, 20 bp, Artificial sequence
  Synthetic oligonucleotide
aggtctgcgataaatgggaa

SEQ ID NO: 108 - DNA, 20 bp, Artificial sequence
  Synthetic oligonucleotide
aaaggtctgcgataaatggg

SEQ ID NO: 109 - DNA, 20 bp, Artificial sequence
  Synthetic oligonucleotide
aaaaggtctgcgataaatgg

SEQ ID NO: 110 - DNA, 20 bp, Artificial sequence
  Synthetic oligonucleotide
aaaaaggtctgcgataaatg

SEQ ID NO: 111 - DNA, 20 bp, Artificial sequence
  Synthetic oligonucleotide
catgaaggccactcttccaa

SEQ ID NO: 112 - DNA, 20 bp, Artificial sequence
  Synthetic oligonucleotide
ccatgaaggccactcttcca

SEQ ID NO: 113 - DNA, 20 bp, Artificial sequence
  Synthetic oligonucleotide
cccatgaaggccactcttcc

SEQ ID NO: 114 - DNA, 20 bp, Artificial sequence
  Synthetic oligonucleotide
tgcccatgaaggccactctt

SEQ ID NO: 115 - DNA, 20 bp, Artificial sequence
  Synthetic oligonucleotide
ttgcccatgaaggccactct

SEQ ID NO: 116 - DNA, 20 bp, Artificial sequence
  Synthetic oligonucleotide
gttgcccatgaaggccactc

SEQ ID NO: 117 - DNA, 20 bp, Artificial sequence
  Synthetic oligonucleotide
ggtctttcatgaatcaagct

SEQ ID NO: 118 - DNA, 20 bp, Artificial sequence
  Synthetic oligonucleotide
tggtctttcatgaatcaagc

SEQ ID NO: 119 - DNA, 20 bp, Artificial sequence
  Synthetic oligonucleotide
atggtctttcatgaatcaag

SEQ ID NO: 120 - DNA, 20 bp, Artificial sequence
  Synthetic oligonucleotide
tgatggtctttcatgaatca

SEQ ID NO: 121 - DNA, 20 bp, Artificial sequence
  Synthetic oligonucleotide
ctgatggtctttcatgaatc

SEQ ID NO: 122 - DNA, 20 bp, Artificial sequence
  Synthetic oligonucleotide
gctgatggtctttcatgaat

SEQ ID NO: 123 - DNA, 20 bp, Artificial sequence
  Synthetic oligonucleotide
gtacccaaaccaacactaat

SEQ ID NO: 124 - DNA, 20 bp, Artificial sequence
  Synthetic oligonucleotide
tgtacccaaaccaacactaa

SEQ ID NO: 125 - DNA, 20 bp, Artificial sequence
  Synthetic oligonucleotide
atgtacccaaaccaacacta

SEQ ID NO: 126 - DNA, 20 bp, Artificial sequence
  Synthetic oligonucleotide
gacatgtacccaaaccaaca

SEQ ID NO: 127 - DNA, 20 bp, Artificial sequence
  Synthetic oligonucleotide
agacatgtacccaaaccaac

SEQ ID NO: 128 - DNA, 20 bp, Artificial sequence
  Synthetic oligonucleotide
aggaatggaaaaccaaatat

SEQ ID NO: 129 - DNA, 20 bp, Artificial sequence
  Synthetic oligonucleotide
caggaatggaaaaccaaata

SEQ ID NO: 130 - DNA, 20 bp, Artificial sequence
  Synthetic oligonucleotide
tcaggaatggaaaaccaaat

SEQ ID NO: 131 - DNA, 20 bp, Artificial sequence
  Synthetic oligonucleotide
actcaggaatggaaaaccaa

SEQ ID NO: 132 - DNA, 20 bp, Artificial sequence
  Synthetic oligonucleotide
aactcaggaatggaaaacca

SEQ ID NO: 133 - DNA, 20 bp, Artificial sequence
  Synthetic oligonucleotide
taactcaggaatggaaaacc

SEQ ID NO: 134 - DNA, 20 bp, Artificial sequence
  Synthetic oligonucleotide
caaaattactgcagtcacag

SEQ ID NO: 135 - DNA, 20 bp, Artificial sequence
  Synthetic oligonucleotide
acaaaattactgcagtcaca

SEQ ID NO: 136 - DNA, 20 bp, Artificial sequence
  Synthetic oligonucleotide
tacaaaattactgcagtcac

SEQ ID NO: 137 - DNA, 20 bp, Artificial sequence
  Synthetic oligonucleotide
catacaaaattactgcagtc

SEQ ID NO: 138 - DNA, 20 bp, Artificial sequence
  Synthetic oligonucleotide
acatacaaaattactgcagt

SEQ ID NO: 139 - DNA, 20 bp, Artificial sequence
  Synthetic oligonucleotide
aacatacaaaattactgcag

SEQ ID NO: 140 - DNA, 20 bp, Artificial sequence
  Synthetic oligonucleotide
ttttagtatgaaccttaaaa

SEQ ID NO: 141 - DNA, 20 bp, Artificial sequence
  Synthetic oligonucleotide
cttttagtatgaaccttaaa

SEQ ID NO: 142 - DNA, 20 bp, Artificial sequence
  Synthetic oligonucleotide
tcttttagtatgaaccttaa

SEQ ID NO: 143 - DNA, 20 bp, Artificial sequence
  Synthetic oligonucleotide
aatcttttagtatgaacctt

SEQ ID NO: 144 - DNA, 20 bp, Artificial sequence
  Synthetic oligonucleotide
caatcttttagtatgaacct

SEQ ID NO: 145 - DNA, 20 bp, Artificial sequence
  Synthetic oligonucleotide
acaatcttttagtatgaacc

SEQ ID NO: 146 - DNA, 20 bp, Artificial sequence
  Synthetic oligonucleotide
aagttatgtgactctgagca

SEQ ID NO: 147 - DNA, 20 bp, Artificial sequence
  Synthetic oligonucleotide
caagttatgtgactctgagc

SEQ ID NO: 148 - DNA, 20 bp, Artificial sequence
  Synthetic oligonucleotide
tcaagttatgtgactctgag

SEQ ID NO: 149 - DNA, 20 bp, Artificial sequence
  Synthetic oligonucleotide
agttctccattagggttctg

SEQ ID NO: 150 - DNA, 20 bp, Artificial sequence
  Synthetic oligonucleotide
tagttctccattagggttct

SEQ ID NO: 151 - DNA, 20 bp, Artificial sequence
  Synthetic oligonucleotide
atagttctccattagggttc

SEQ ID NO: 152 - DNA, 20 bp, Artificial sequence
  Synthetic oligonucleotide
aagcaggttggcagacagac

SEQ ID NO: 153 - DNA, 20 bp, Artificial sequence
  Synthetic oligonucleotide
gaagcaggttggcagacaga

SEQ ID NO: 154 - DNA, 20 bp, Artificial sequence
  Synthetic oligonucleotide
ggaagcaggttggcagacag

SEQ ID NO: 155 - DNA, 20 bp, Artificial sequence
  Synthetic oligonucleotide
tcttcttgtgagctggcttc

SEQ ID NO: 156 - DNA, 20 bp, Artificial sequence
  Synthetic oligonucleotide
gtcttcttgtgagctggctt

SEQ ID NO: 157 - DNA, 20 bp, Artificial sequence
  Synthetic oligonucleotide
agtcttcttgtgagctggct

SEQ ID NO: 158 - DNA, 20 bp, Artificial sequence
  Synthetic oligonucleotide
taagtcttcttgtgagctgg

SEQ ID NO: 159 - DNA, 20 bp, Artificial sequence
  Synthetic oligonucleotide
ttaagtcttcttgtgagctg

SEQ ID NO: 160 - DNA, 20 bp, Artificial sequence
  Synthetic oligonucleotide
attaagtcttcttgtgagct

SEQ ID NO: 161 - DNA, 20 bp, Artificial sequence
  Synthetic oligonucleotide
tctcttccactcacatccat

SEQ ID NO: 162 - DNA, 20 bp, Artificial sequence
  Synthetic oligonucleotide
gtctcttccactcacatcca

SEQ ID NO: 163 - DNA, 20 bp, Artificial sequence
  Synthetic oligonucleotide
agtctcttccactcacatcc

SEQ ID NO: 164 - DNA, 20 bp, Artificial sequence
  Synthetic oligonucleotide
taagtatttgtagcagttgc

SEQ ID NO: 165 - DNA, 20 bp, Artificial sequence
  Synthetic oligonucleotide
ctaagtatttgtagcagttg

SEQ ID NO: 166 - DNA, 20 bp, Artificial sequence
  Synthetic oligonucleotide
gctaagtatttgtagcagtt

SEQ ID NO: 167 - DNA, 20 bp, Artificial sequence
  Synthetic oligonucleotide
tggctaagtatttgtagcag

SEQ ID NO: 168 - DNA, 20 bp, Artificial sequence
  Synthetic oligonucleotide
ttggctaagtatttgtagca

SEQ ID NO: 169 - DNA, 20 bp, Artificial sequence
  Synthetic oligonucleotide
tttggctaagtatttgtagc

SEQ ID NO: 170 - DNA, 20 bp, Artificial sequence
  Synthetic oligonucleotide
aaaatgtcaacagtgcatag

SEQ ID NO: 171 - DNA, 20 bp, Artificial sequence
  Synthetic oligonucleotide
caaaatgtcaacagtgcata

SEQ ID NO: 172 - DNA, 20 bp, Artificial sequence
  Synthetic oligonucleotide
ccaaaatgtcaacagtgcat

SEQ ID NO: 173 - DNA, 20 bp, Artificial sequence
  Synthetic oligonucleotide
gcccaaaatgtcaacagtgc

SEQ ID NO: 174 - DNA, 20 bp, Artificial sequence
  Synthetic oligonucleotide
ggcccaaaatgtcaacagtg

SEQ ID NO: 175 - DNA, 20 bp, Artificial sequence
  Synthetic oligonucleotide
tggcccaaaatgtcaacagt

SEQ ID NO: 176 - DNA, 20 bp, Artificial sequence
  Synthetic oligonucleotide
cagaatcttctctttggcca

SEQ ID NO: 177 - DNA, 20 bp, Artificial sequence
  Synthetic oligonucleotide
gcagaatcttctctttggcc

SEQ ID NO: 178 - DNA, 20 bp, Artificial sequence
  Synthetic oligonucleotide
tgcagaatcttctctttggc

SEQ ID NO: 179 - DNA, 20 bp, Artificial sequence
  Synthetic oligonucleotide
tttgcagaatcttctctttg

SEQ ID NO: 180 - DNA, 20 bp, Artificial sequence
  Synthetic oligonucleotide
atttgcagaatcttctcttt

SEQ ID NO: 181 - DNA, 20 bp, Artificial sequence
  Synthetic oligonucleotide
aatttgcagaatcttctctt

SEQ ID NO: 182 - DNA, 20 bp, Artificial sequence
  Synthetic oligonucleotide
ataaagctatgccataaagc

SEQ ID NO: 183 - DNA, 20 bp, Artificial sequence
  Synthetic oligonucleotide
cataaagctatgccataaag

SEQ ID NO: 184 - DNA, 20 bp, Artificial sequence
  Synthetic oligonucleotide
ccataaagctatgccataaa

SEQ ID NO: 185 - DNA, 20 bp, Artificial sequence
  Synthetic oligonucleotide
gaccataaagctatgccata

SEQ ID NO: 186 - DNA, 20 bp, Artificial sequence
  Synthetic oligonucleotide
tgaccataaagctatgccat

SEQ ID NO: 187 - DNA, 20 bp, Artificial sequence
  Synthetic oligonucleotide
ctgaccataaagctatgcca

SEQ ID NO: 188 - DNA, 20 bp, Artificial sequence
  Synthetic oligonucleotide
caaaaagttgagctgagaaa

SEQ ID NO: 189 - DNA, 20 bp, Artificial sequence
  Synthetic oligonucleotide
ccaaaaagttgagctgagaa

SEQ ID NO: 190 - DNA, 20 bp, Artificial sequence
  Synthetic oligonucleotide
cccaaaaagttgagctgaga

SEQ ID NO: 191 - DNA, 20 bp, Artificial sequence
  Synthetic oligonucleotide
cacccaaaaagttgagctga

SEQ ID NO: 192 - DNA, 20 bp, Artificial sequence
  Synthetic oligonucleotide
acacccaaaaagttgagctg

SEQ ID NO: 193 - DNA, 20 bp, Artificial sequence
  Synthetic oligonucleotide
tacacccaaaaagttgagct

SEQ ID NO: 194 - DNA, 20 bp, Artificial sequence
  Synthetic oligonucleotide
cttttaatggcacccaagca

SEQ ID NO: 195 - DNA, 20 bp, Artificial sequence
  Synthetic oligonucleotide
gcttttaatggcacccaagc

SEQ ID NO: 196 - DNA, 20 bp, Artificial sequence
  Synthetic oligonucleotide
tgcttttaatggcacccaag

SEQ ID NO: 197 - DNA, 20 bp, Artificial sequence
  Synthetic oligonucleotide
aatgcttttaatggcaccca

SEQ ID NO: 198 - DNA, 20 bp, Artificial sequence
  Synthetic oligonucleotide
aaatgcttttaatggcaccc

SEQ ID NO: 199 - DNA, 20 bp, Artificial sequence
  Synthetic oligonucleotide
gaaatgcttttaatggcacc

SEQ ID NO: 200 - DNA, 20 bp, Artificial sequence
  Synthetic oligonucleotide
taattcttaagggccctctg

SEQ ID NO: 201 - DNA, 20 bp, Artificial sequence
  Synthetic oligonucleotide
ataattcttaagggccctct

SEQ ID NO: 202 - DNA, 20 bp, Artificial sequence
  Synthetic oligonucleotide
cataattcttaagggccctc

SEQ ID NO: 203 - DNA, 20 bp, Artificial sequence
  Synthetic oligonucleotide
agcataattcttaagggccc

SEQ ID NO: 204 - DNA, 20 bp, Artificial sequence
  Synthetic oligonucleotide
tagcataattcttaagggcc

SEQ ID NO: 205 - DNA, 20 bp, Artificial sequence
  Synthetic oligonucleotide
ttagcataattcttaagggc

SEQ ID NO: 206 - DNA, 20 bp, Artificial sequence
  Synthetic oligonucleotide
aggaatggaaaaccaaacat

SEQ ID NO: 207 - DNA, 20 bp, Artificial sequence
  Synthetic oligonucleotide
caggaatggaaaaccaaaca

SEQ ID NO: 208 - DNA, 20 bp, Artificial sequence
  Synthetic oligonucleotide
tcaggaatggaaaaccaaac

SEQ ID NO: 209 - DNA, 20 bp, Artificial sequence
  Synthetic oligonucleotide
aggaatggaaaaccaaatac

SEQ ID NO: 210 - DNA, 20 bp, Artificial sequence
  Synthetic oligonucleotide
catgactatgttctggcaag

SEQ ID NO: 211 - DNA, 20 bp, Artificial sequence
  Synthetic oligonucleotide
acatgactatgttctggcaa

SEQ ID NO: 212 - DNA, 20 bp, Artificial sequence
  Synthetic oligonucleotide
cacatgactatgttctggca

SEQ ID NO: 213 - DNA, 20 bp, Artificial sequence
  Synthetic oligonucleotide
gtcacatgactatgttctgg

SEQ ID NO: 214 - DNA, 20 bp, Artificial sequence
  Synthetic oligonucleotide
ggtcacatgactatgttctg

SEQ ID NO: 215 - DNA, 20 bp, Artificial sequence
  Synthetic oligonucleotide
tggtcacatgactatgttct

SEQ ID NO: 216 - DNA, 20 bp, Artificial sequence
  Synthetic oligonucleotide
ctgaattctgagctctggaa

SEQ ID NO: 217 - DNA, 20 bp, Artificial sequence
  Synthetic oligonucleotide
cctgaattctgagctctgga

SEQ ID NO: 218 - DNA, 20 bp, Artificial sequence
  Synthetic oligonucleotide
gcctgaattctgagctctgg

SEQ ID NO: 219 - DNA, 20 bp, Artificial sequence
  Synthetic oligonucleotide
aagcctgaattctgagctct

SEQ ID NO: 220 - DNA, 20 bp, Artificial sequence
  Synthetic oligonucleotide
caagcctgaattctgagctc

SEQ ID NO: 221 - DNA, 20 bp, Artificial sequence
  Synthetic oligonucleotide
acaagcctgaattctgagct

SEQ ID NO: 222 - DNA, 20 bp, Artificial sequence
  Synthetic oligonucleotide
ggatctcagctgcaattctt

SEQ ID NO: 223 - DNA, 20 bp, Artificial sequence
  Synthetic oligonucleotide
aggatctcagctgcaattct

SEQ ID NO: 224 - DNA, 20 bp, Artificial sequence
  Synthetic oligonucleotide
gaggatctcagctgcaattc

SEQ ID NO: 225 - DNA, 20 bp, Artificial sequence
  Synthetic oligonucleotide
cagaggatctcagctgcaat

SEQ ID NO: 226 - DNA, 20 bp, Artificial sequence
  Synthetic oligonucleotide
gcagaggatctcagctgcaa

SEQ ID NO: 227 - DNA, 20 bp, Artificial sequence
  Synthetic oligonucleotide
aaaagcatcacttgatcctg

SEQ ID NO: 228 - DNA, 17 bp, Artificial sequence
  Synthetic oligonucleotide
caaggtcaacagcagct

SEQ ID NO: 229 - DNA, 17 bp, Artificial sequence
  Synthetic oligonucleotide
ccaaggtcaacagcagc

SEQ ID NO: 230 - DNA, 17 bp, Artificial sequence
  Synthetic oligonucleotide
gccaaggtcaacagcag

SEQ ID NO: 231 - DNA, 17 bp, Artificial sequence
  Synthetic oligonucleotide
tctcacacgcacttcat

SEQ ID NO: 232 - DNA, 17 bp, Artificial sequence
  Synthetic oligonucleotide
atctcacacgcacttca

SEQ ID NO: 233 - DNA, 17 bp, Artificial sequence
  Synthetic oligonucleotide
gatctcacacgcacttc

SEQ ID NO: 234 - DNA, 17 bp, Artificial sequence
  Synthetic oligonucleotide
ctttcatgaatcaagct

SEQ ID NO: 235 - DNA, 17 bp, Artificial sequence
  Synthetic oligonucleotide
tctttcatgaatcaagc

SEQ ID NO: 236 - DNA, 17 bp, Artificial sequence
  Synthetic oligonucleotide
gtctttcatgaatcaag

SEQ ID NO: 237 - DNA, 17 bp, Artificial sequence
  Synthetic oligonucleotide
ggtctttcatgaatcaa

SEQ ID NO: 238 - DNA, 17 bp, Artificial sequence
  Synthetic oligonucleotide
atggtctttcatgaatc

SEQ ID NO: 239 - DNA, 17 bp, Artificial sequence
  Synthetic oligonucleotide
gatggtctttcatgaat

SEQ ID NO: 240 - DNA, 17 bp, Artificial sequence
  Synthetic oligonucleotide
tatatcaatattctccc

SEQ ID NO: 241 - DNA, 17 bp, Artificial sequence
  Synthetic oligonucleotide
ttatatcaatattctcc

SEQ ID NO: 242 - DNA, 17 bp, Artificial sequence
  Synthetic oligonucleotide
gttatatcaatattctc

SEQ ID NO: 243 - DNA, 17 bp, Artificial sequence
  Synthetic oligonucleotide
tttctttagcaatagtt

SEQ ID NO: 244 - DNA, 17 bp, Artificial sequence
  Synthetic oligonucleotide
ctttctttagcaatagt

SEQ ID NO: 245 - DNA, 17 bp, Artificial sequence
  Synthetic oligonucleotide
gctttctttagcaatag

SEQ ID NO: 246 - DNA, 17 bp, Artificial sequence
  Synthetic oligonucleotide
aggaatggaaaaccaaa

SEQ ID NO: 247 - DNA, 17 bp, Artificial sequence
  Synthetic oligonucleotide
caggaatggaaaaccaa

SEQ ID NO: 248 - DNA, 17 bp, Artificial sequence
  Synthetic oligonucleotide
tcaggaatggaaaacca

SEQ ID NO: 249 - DNA, 17 bp, Artificial sequence
  Synthetic oligonucleotide
tctccattagggttctg

SEQ ID NO: 250 - DNA, 17 bp, Artificial sequence
  Synthetic oligonucleotide
ttctccattagggttct

SEQ ID NO: 251 - DNA, 17 bp, Artificial sequence
  Synthetic oligonucleotide
gttctccattagggttc

SEQ ID NO: 252 - DNA, 17 bp, Artificial sequence
  Synthetic oligonucleotide
aggttggcagacagaca

SEQ ID NO: 253 - DNA, 17 bp, Artificial sequence
  Synthetic oligonucleotide
caggttggcagacagac

SEQ ID NO: 254 - DNA, 17 bp, Artificial sequence
  Synthetic oligonucleotide
gcaggttggcagacaga

SEQ ID NO: 255 - DNA, 17 bp, Artificial sequence
  Synthetic oligonucleotide
cttcttgtgagctggct

SEQ ID NO: 256 - DNA, 17 bp, Artificial sequence
  Synthetic oligonucleotide
tcttcttgtgagctggc

SEQ ID NO: 257 - DNA, 17 bp, Artificial sequence
  Synthetic oligonucleotide
gtcttcttgtgagctgg

SEQ ID NO: 258 - DNA, 17 bp, Artificial sequence
  Synthetic oligonucleotide
agtcttcttgtgagctg

SEQ ID NO: 259 - DNA, 17 bp, Artificial sequence
  Synthetic oligonucleotide
tcttccactcacatcca

SEQ ID NO: 260 - DNA, 17 bp, Artificial sequence
  Synthetic oligonucleotide
ctcttccactcacatcc

SEQ ID NO: 261 - DNA, 17 bp, Artificial sequence
  Synthetic oligonucleotide
tctcttccactcacatc

SEQ ID NO: 262 - DNA, 17 bp, Artificial sequence
  Synthetic oligonucleotide
gtctcttccactcacat

SEQ ID NO: 263 - DNA, 17 bp, Artificial sequence
  Synthetic oligonucleotide
atagattttgacttccc

SEQ ID NO: 264 - DNA, 17 bp, Artificial sequence
  Synthetic oligonucleotide
catagattttgacttcc

SEQ ID NO: 265 - DNA, 17 bp, Artificial sequence
  Synthetic oligonucleotide
gcatagattttgacttc

SEQ ID NO: 266 - DNA, 17 bp, Artificial sequence
  Synthetic oligonucleotide
aaaatgtcaacagtgca

SEQ ID NO: 267 - DNA, 17 bp, Artificial sequence
  Synthetic oligonucleotide
caaaatgtcaacagtgc

SEQ ID NO: 268 - DNA, 17 bp, Artificial sequence
  Synthetic oligonucleotide
ccaaaatgtcaacagtg

SEQ ID NO: 269 - DNA, 17 bp, Artificial sequence
  Synthetic oligonucleotide
cccaaaatgtcaacagt

SEQ ID NO: 270 - DNA, 17 bp, Artificial sequence
  Synthetic oligonucleotide
catgactatgttctggc

SEQ ID NO: 271 - DNA, 17 bp, Artificial sequence
  Synthetic oligonucleotide
acatgactatgttctgg

SEQ ID NO: 272 - DNA, 17 bp, Artificial sequence
  Synthetic oligonucleotide
cacatgactatgttctg

SEQ ID NO: 273 - DNA, 17 bp, Artificial sequence
  Synthetic oligonucleotide
gaattctgagctctgga

SEQ ID NO: 274 - DNA, 17 bp, Artificial sequence
  Synthetic oligonucleotide
tgaattctgagctctgg

SEQ ID NO: 275 - DNA, 17 bp, Artificial sequence
  Synthetic oligonucleotide
ctgaattctgagctctg

SEQ ID NO: 276 - DNA, 17 bp, Artificial sequence
  Synthetic oligonucleotide
cctgaattctgagctct

SEQ ID NO: 277 - DNA, 17 bp, Artificial sequence
  Synthetic oligonucleotide
gcctgaattctgagctc

SEQ ID NO: 278 - DNA, 17 bp, Artificial sequence
  Synthetic oligonucleotide
agcctgaattctgagct

SEQ ID NO: 279 - DNA, 17 bp, Artificial sequence
  Synthetic oligonucleotide
atattgtaattcttggt

SEQ ID NO: 280 - DNA, 17 bp, Artificial sequence
  Synthetic oligonucleotide
gatattgtaattcttgg

SEQ ID NO: 281 - DNA, 17 bp, Artificial sequence
  Synthetic oligonucleotide
tgatattgtaattcttg

SEQ ID NO: 282 - DNA, 17 bp, Artificial sequence
  Synthetic oligonucleotide
ctgatattgtaattctt

SEQ ID NO: 283 - DNA, 17 bp, Artificial sequence
  Synthetic oligonucleotide
cctgatattgtaattct

SEQ ID NO: 284 - DNA, 17 bp, Artificial sequence
  Synthetic oligonucleotide
gcctgatattgtaattc

SEQ ID NO: 285 - DNA, 17 bp, Artificial sequence
  Synthetic oligonucleotide
tgcctgatattgtaatt

SEQ ID NO: 286 - DNA, 17 bp, Artificial sequence
  Synthetic oligonucleotide
aattatgtgctttgcct

SEQ ID NO: 287 - DNA, 17 bp, Artificial sequence
  Synthetic oligonucleotide
caattatgtgctttgcc

SEQ ID NO: 288 - DNA, 17 bp, Artificial sequence
  Synthetic oligonucleotide
tcaattatgtgctttgc

SEQ ID NO: 289 - DNA, 17 bp, Artificial sequence
  Synthetic oligonucleotide
gtcaattatgtgctttg

SEQ ID NO: 290 - DNA, 17 bp, Artificial sequence
  Synthetic oligonucleotide
gccatcaccaaacacca

SEQ ID NO: 291 - DNA, 17 bp, Artificial sequence
  Synthetic oligonucleotide
tgccatcaccaaacacc

SEQ ID NO: 292 - DNA, 17 bp, Artificial sequence
  Synthetic oligonucleotide
ttgccatcaccaaacac

SEQ ID NO: 293 - DNA, 17 bp, Artificial sequence
  Synthetic oligonucleotide
tggtgactctgcctgat

SEQ ID NO: 294 - DNA, 17 bp, Artificial sequence
  Synthetic oligonucleotide
ctggtgactctgcctga

SEQ ID NO: 295 - DNA, 20 bp, Artificial sequence
  Synthetic oligonucleotide
tatttcagaaagactttctg

SEQ ID NO: 296 - DNA, 20 bp, Artificial sequence
  Synthetic oligonucleotide
aggaaaaaatcaaggagtta

SEQ ID NO: 297 - DNA, 20 bp, Artificial sequence
  Synthetic oligonucleotide
tatttactgaacacctattc

SEQ ID NO: 298 - DNA, 20 bp, Artificial sequence
  Synthetic oligonucleotide
gcccatgaaggccactcttc

SEQ ID NO: 299 - DNA, 20 bp, Artificial sequence
  Synthetic oligonucleotide
acctataaataaagtgagga

SEQ ID NO: 300 - DNA, 20 bp, Artificial sequence
  Synthetic oligonucleotide
gtttcataacctgctaataa

SEQ ID NO: 301 - DNA, 20 bp, Artificial sequence
  Synthetic oligonucleotide
atgtgccttacagttatcag

SEQ ID NO: 302 - DNA, 20 bp, Artificial sequence
  Synthetic oligonucleotide
ttctgaatttagaattatag

SEQ ID NO: 303 - DNA, 20 bp, Artificial sequence
  Synthetic oligonucleotide
gtttataatctagcagttac

SEQ ID NO: 304 - DNA, 20 bp, Artificial sequence
  Synthetic oligonucleotide
gatggtctttcatgaatcaa

SEQ ID NO: 305 - DNA, 20 bp, Artificial sequence
  Synthetic oligonucleotide
catgtacccaaaccaacact

SEQ ID NO: 306 - DNA, 20 bp, Artificial sequence
  Synthetic oligonucleotide
taaaatacagcctacatcat

SEQ ID NO: 307 - DNA, 20 bp, Artificial sequence
  Synthetic oligonucleotide
ccatcactacaacaaactca

SEQ ID NO: 308 - DNA, 20 bp, Artificial sequence
  Synthetic oligonucleotide
atctgaaatgatcccctttc

SEQ ID NO: 309 - DNA, 20 bp, Artificial sequence
  Synthetic oligonucleotide
tgttgcccctccaaaaagac

SEQ ID NO: 310 - DNA, 20 bp, Artificial sequence
  Synthetic oligonucleotide
attaaaattttaaatgatgt

SEQ ID NO: 311 - DNA, 20 bp, Artificial sequence
  Synthetic oligonucleotide
ctcaggaatggaaaaccaaa

SEQ ID NO: 312 - DNA, 20 bp, Artificial sequence
  Synthetic oligonucleotide
aaaattctagaagataacat

SEQ ID NO: 313 - DNA, 20 bp, Artificial sequence
  Synthetic oligonucleotide
ctagaagtcctagccagagt

SEQ ID NO: 314 - DNA, 20 bp, Artificial sequence
  Synthetic oligonucleotide
aaccgatatcacagaaatac

SEQ ID NO: 315 - DNA, 20 bp, Artificial sequence
  Synthetic oligonucleotide
aagatagacagtaacataat

SEQ ID NO: 316 - DNA, 20 bp, Artificial sequence
  Synthetic oligonucleotide
gcactacaagaactgcttaa

SEQ ID NO: 317 - DNA, 20 bp, Artificial sequence
  Synthetic oligonucleotide
tttccagacaaagaattcag

SEQ ID NO: 318 - DNA, 20 bp, Artificial sequence
  Synthetic oligonucleotide
gtagacagcctttctggaac

SEQ ID NO: 319 - DNA, 20 bp, Artificial sequence
  Synthetic oligonucleotide
catcctacatagtggctgtg

SEQ ID NO: 320 - DNA, 20 bp, Artificial sequence
  Synthetic oligonucleotide
cagaacagtgtgtggagact

SEQ ID NO: 321 - DNA, 20 bp, Artificial sequence
  Synthetic oligonucleotide
agctttaaaaatacctctgc

SEQ ID NO: 322 - DNA, 20 bp, Artificial sequence
  Synthetic oligonucleotide
cccaggtacttgctctcaga

SEQ ID NO: 323 - DNA, 20 bp, Artificial sequence
  Synthetic oligonucleotide
ttacacctgattctagaaat

SEQ ID NO: 324 - DNA, 20 bp, Artificial sequence
  Synthetic oligonucleotide
cttttctctacaacctcaca

SEQ ID NO: 325 - DNA, 20 bp, Artificial sequence
  Synthetic oligonucleotide
tagtagtttgaatttcaaag

SEQ ID NO: 326 - DNA, 20 bp, Artificial sequence
  Synthetic oligonucleotide
atacaaaattactgcagtca

SEQ ID NO: 327 - DNA, 20 bp, Artificial sequence
  Synthetic oligonucleotide
gccactgccaaaaaggagga

SEQ ID NO: 328 - DNA, 20 bp, Artificial sequence
  Synthetic oligonucleotide
tgacagaaacagagctatga

SEQ ID NO: 329 - DNA, 20 bp, Artificial sequence
  Synthetic oligonucleotide
atcttttagtatgaacctta

SEQ ID NO: 330 - DNA, 20 bp, Artificial sequence
  Synthetic oligonucleotide
agttatgtgactctgagcac

SEQ ID NO: 331 - DNA, 20 bp, Artificial sequence
  Synthetic oligonucleotide
actatgccctagttacttct

SEQ ID NO: 332 - DNA, 20 bp, Artificial sequence
  Synthetic oligonucleotide
tatagtggaagtgatagatc

SEQ ID NO: 333 - DNA, 20 bp, Artificial sequence
  Synthetic oligonucleotide
tgttttctgaaatggaatgt

SEQ ID NO: 334 - DNA, 20 bp, Artificial sequence
  Synthetic oligonucleotide
gctgtaaatgtaatgagtgt

SEQ ID NO: 335 - DNA, 20 bp, Artificial sequence
  Synthetic oligonucleotide
gagagaagccatggccctag

SEQ ID NO: 336 - DNA, 20 bp, Artificial sequence
  Synthetic oligonucleotide
ctctctttcccagaacaaga

SEQ ID NO: 337 - DNA, 20 bp, Artificial sequence
  Synthetic oligonucleotide
tccaaaatgtccagtataat

SEQ ID NO: 338 - DNA, 20 bp, Artificial sequence
  Synthetic oligonucleotide
gttctccattagggttctgg

SEQ ID NO: 339 - DNA, 20 bp, Artificial sequence
  Synthetic oligonucleotide
ttagtcacccatccaccact

SEQ ID NO: 340 - DNA, 20 bp, Artificial sequence
  Synthetic oligonucleotide
catgaattcaccgagttagg

SEQ ID NO: 341 - DNA, 20 bp, Artificial sequence
  Synthetic oligonucleotide
agcaggttggcagacagaca

SEQ ID NO: 342 - DNA, 20 bp, Artificial sequence
  Synthetic oligonucleotide
gaaagacttaaattttcaca

SEQ ID NO: 343 - DNA, 20 bp, Artificial sequence
  Synthetic oligonucleotide
tagtagaggaaaaggagaat

SEQ ID NO: 344 - DNA, 20 bp, Artificial sequence
  Synthetic oligonucleotide
aaacagggtctggagtggac

SEQ ID NO: 345 - DNA, 20 bp, Artificial sequence
  Synthetic oligonucleotide
caagctgataattaaaaaga

SEQ ID NO: 346 - DNA, 20 bp, Artificial sequence
  Synthetic oligonucleotide
ataaagatacattttctggg

SEQ ID NO: 347 - DNA, 20 bp, Artificial sequence
  Synthetic oligonucleotide
caggattcttcctgcctggc

SEQ ID NO: 348 - DNA, 20 bp, Artificial sequence
  Synthetic oligonucleotide
aagtcttcttgtgagctggc

SEQ ID NO: 349 - DNA, 20 bp, Artificial sequence
  Synthetic oligonucleotide
ctcttccactcacatccatt

SEQ ID NO: 350 - DNA, 20 bp, Artificial sequence
  Synthetic oligonucleotide
cctatatcagaagacaaatg

SEQ ID NO: 351 - DNA, 20 bp, Artificial sequence
  Synthetic oligonucleotide
tcaaaaccctgccaaggtac

SEQ ID NO: 352 - DNA, 20 bp, Artificial sequence
  Synthetic oligonucleotide
tcatattctacttctgttta

SEQ ID NO: 353 - DNA, 20 bp, Artificial sequence
  Synthetic oligonucleotide
cattccagtgtttcagtaag

SEQ ID NO: 354 - DNA, 20 bp, Artificial sequence
  Synthetic oligonucleotide
ggcctggaattaatcctcag

SEQ ID NO: 355 - DNA, 20 bp, Artificial sequence
  Synthetic oligonucleotide
aatgccctctccctgtgcct

SEQ ID NO: 356 - DNA, 20 bp, Artificial sequence
  Synthetic oligonucleotide
tttataatcaacctttgcta

SEQ ID NO: 357 - DNA, 20 bp, Artificial sequence
  Synthetic oligonucleotide
atataactacttaaaataat

SEQ ID NO: 358 - DNA, 20 bp, Artificial sequence
  Synthetic oligonucleotide
ttagccaggatatggttgcc

SEQ ID NO: 359 - DNA, 20 bp, Artificial sequence
  Synthetic oligonucleotide
ctacctccatcaaagaaaat

SEQ ID NO: 360 - DNA, 20 bp, Artificial sequence
  Synthetic oligonucleotide
gcatgcatagataagtttga

SEQ ID NO: 361 - DNA, 20 bp, Artificial sequence
  Synthetic oligonucleotide
atgagagtaaatggattttc

SEQ ID NO: 362 - DNA, 20 bp, Artificial sequence
  Synthetic oligonucleotide
ttggcaatccttgcttaaaa

SEQ ID NO: 363 - DNA, 20 bp, Artificial sequence
  Synthetic oligonucleotide
gaattaagccagacttattt

SEQ ID NO: 364 - DNA, 20 bp, Artificial sequence
  Synthetic oligonucleotide
ggctaagtatttgtagcagt

SEQ ID NO: 365 - DNA, 20 bp, Artificial sequence
  Synthetic oligonucleotide
ttgcctgtgtgcaactggcg

SEQ ID NO: 366 - DNA, 20 bp, Artificial sequence
  Synthetic oligonucleotide
gtggccttagtaggccagct

SEQ ID NO: 367 - DNA, 20 bp, Artificial sequence
  Synthetic oligonucleotide
cccaaaatgtcaacagtgca

SEQ ID NO: 368 - DNA, 20 bp, Artificial sequence
  Synthetic oligonucleotide
ttaagccttcaatttgaaaa

SEQ ID NO: 369 - DNA, 20 bp, Artificial sequence
  Synthetic oligonucleotide
tgctcagaaggttgagcata

SEQ ID NO: 370 - DNA, 20 bp, Artificial sequence
  Synthetic oligonucleotide
ttaatgctttcccaaagctc

SEQ ID NO: 371 - DNA, 20 bp, Artificial sequence
  Synthetic oligonucleotide
aaaagacttcatacctttac

SEQ ID NO: 372 - DNA, 20 bp, Artificial sequence
  Synthetic oligonucleotide
ggccccctggcacaacagga

SEQ ID NO: 373 - DNA, 20 bp, Artificial sequence
  Synthetic oligonucleotide
tctagggtgattcaggtgga

SEQ ID NO: 374 - DNA, 20 bp, Artificial sequence
  Synthetic oligonucleotide
cttagattaatgcaaaacaa

SEQ ID NO: 375 - DNA, 20 bp, Artificial sequence
  Synthetic oligonucleotide
aggcagaggagggtggaacc

SEQ ID NO: 376 - DNA, 20 bp, Artificial sequence
  Synthetic oligonucleotide
agtctaatgagatctgatgg

SEQ ID NO: 377 - DNA, 20 bp, Artificial sequence
  Synthetic oligonucleotide
gctgaaatgagttaagactt

SEQ ID NO: 378 - DNA, 20 bp, Artificial sequence
  Synthetic oligonucleotide
actttggactgtggattttt

SEQ ID NO: 379 - DNA, 20 bp, Artificial sequence
  Synthetic oligonucleotide
gcatatttacacaatgcctg

SEQ ID NO: 380 - DNA, 20 bp, Artificial sequence
  Synthetic oligonucleotide
ggaaatgcctggatgtccag

SEQ ID NO: 381 - DNA, 20 bp, Artificial sequence
  Synthetic oligonucleotide
ctgctgattttggaatggag

SEQ ID NO: 382 - DNA, 20 bp, Artificial sequence
  Synthetic oligonucleotide
actgaacacctattctatgg

SEQ ID NO: 383 - DNA, 20 bp, Artificial sequence
  Synthetic oligonucleotide
tttactgaacacctattcta

SEQ ID NO: 384 - DNA, 20 bp, Artificial sequence
  Synthetic oligonucleotide
ccctcaaattatccacaaac

SEQ ID NO: 385 - DNA, 20 bp, Artificial sequence
  Synthetic oligonucleotide
cttctaaatgtttccaaggc

SEQ ID NO: 386 - DNA, 20 bp, Artificial sequence
  Synthetic oligonucleotide
ttacatcctgtaggctaatt

SEQ ID NO: 387 - DNA, 20 bp, Artificial sequence
  Synthetic oligonucleotide
ccactagcctggccagactt

SEQ ID NO: 388 - DNA, 20 bp, Artificial sequence
  Synthetic oligonucleotide
ctggtagatgatctcaagtt

SEQ ID NO: 389 - DNA, 20 bp, Artificial sequence
  Synthetic oligonucleotide
aaagaattgagttataaatc

SEQ ID NO: 390 - DNA, 20 bp, Artificial sequence
  Synthetic oligonucleotide
aactcatctctggccagcag

SEQ ID NO: 391 - DNA, 20 bp, Artificial sequence
  Synthetic oligonucleotide
caacatcattgtattttctg

SEQ ID NO: 392 - DNA, 20 bp, Artificial sequence
  Synthetic oligonucleotide
tcttagcttaccaatgagga

SEQ ID NO: 393 - DNA, 20 bp, Artificial sequence
  Synthetic oligonucleotide
ttcccagagccaaagctcaa

SEQ ID NO: 394 - DNA, 20 bp, Artificial sequence
  Synthetic oligonucleotide
tttggccaatcccagcttat

SEQ ID NO: 395 - DNA, 20 bp, Artificial sequence
  Synthetic oligonucleotide
gtttgcaaatcttcattcac

SEQ ID NO: 396 - DNA, 20 bp, Artificial sequence
  Synthetic oligonucleotide
caatagtccctgaggcttgg

SEQ ID NO: 397 - DNA, 20 bp, Artificial sequence
  Synthetic oligonucleotide
tttccccagattaaatgccc

SEQ ID NO: 398 - DNA, 20 bp, Artificial sequence
  Synthetic oligonucleotide
ttcaataatgcagttattat

SEQ ID NO: 399 - DNA, 20 bp, Artificial sequence
  Synthetic oligonucleotide
aaattcttgggcttaagcac

SEQ ID NO: 400 - DNA, 20 bp, Artificial sequence
  Synthetic oligonucleotide
tgatccaaattcagtaccta

SEQ ID NO: 401 - DNA, 20 bp, Artificial sequence
  Synthetic oligonucleotide
gatgatccaaattcagtacc

SEQ ID NO: 402 - DNA, 20 bp, Artificial sequence
  Synthetic oligonucleotide
caatattcatctttatattc

SEQ ID NO: 403 - DNA, 20 bp, Artificial sequence
  Synthetic oligonucleotide
attgctcttaagataagtaa

SEQ ID NO: 404 - DNA, 20 bp, Artificial sequence
  Synthetic oligonucleotide
cagctccctgaatatctctt

SEQ ID NO: 405 - DNA, 20 bp, Artificial sequence
  Synthetic oligonucleotide
acttcacaaatatattataa

SEQ ID NO: 406 - DNA, 20 bp, Artificial sequence
  Synthetic oligonucleotide
gtacagtcaactttacttca

SEQ ID NO: 407 - DNA, 20 bp, Artificial sequence
  Synthetic oligonucleotide
caattcccactcttgtcaac

SEQ ID NO: 408 - DNA, 20 bp, Artificial sequence
  Synthetic oligonucleotide
tcaactgctttctggagcag

SEQ ID NO: 409 - DNA, 20 bp, Artificial sequence
  Synthetic oligonucleotide
actgctgagcacctccaaaa

SEQ ID NO: 410 - DNA, 20 bp, Artificial sequence
  Synthetic oligonucleotide
cttagattcctggtttatca

SEQ ID NO: 411 - DNA, 20 bp, Artificial sequence
  Synthetic oligonucleotide
agttatatcaatattctccc

SEQ ID NO: 412 - DNA, 20 bp, Artificial sequence
  Synthetic oligonucleotide
tataccatcttccccataaa

SEQ ID NO: 413 - DNA, 20 bp, Artificial sequence
  Synthetic oligonucleotide
ggctttctttagcaatagtt

SEQ ID NO: 414 - DNA, 20 bp, Artificial sequence
  Synthetic oligonucleotide
taccagggatgtaggtttac

SEQ ID NO: 415 - DNA, 20 bp, Artificial sequence
  Synthetic oligonucleotide
tcacagctgaattctatctg

SEQ ID NO: 416 - DNA, 20 bp, Artificial sequence
  Synthetic oligonucleotide
ggagatggacaaattcctgc

SEQ ID NO: 417 - DNA, 20 bp, Artificial sequence
  Synthetic oligonucleotide
ctagacatgtcatcaagaca

SEQ ID NO: 418 - DNA, 20 bp, Artificial sequence
  Synthetic oligonucleotide
caaattaataaaacaattac

SEQ ID NO: 419 - DNA, 20 bp, Artificial sequence
  Synthetic oligonucleotide
tattcttatatcagacaaaa

SEQ ID NO: 420 - DNA, 20 bp, Artificial sequence
  Synthetic oligonucleotide
tcaagggatccctgccattc

SEQ ID NO: 421 - DNA, 20 bp, Artificial sequence
  Synthetic oligonucleotide
cgtcaagggatccctgccat

SEQ ID NO: 422 - DNA, 20 bp, Artificial sequence
  Synthetic oligonucleotide
ggcactcccagtctccagct

SEQ ID NO: 423 - DNA, 20 bp, Artificial sequence
  Synthetic oligonucleotide
tttctccagcagaagtgtca

SEQ ID NO: 424 - DNA, 20 bp, Artificial sequence
  Synthetic oligonucleotide
aagtcctcttccgcctccct

SEQ ID NO: 425 - DNA, 20 bp, Artificial sequence
  Synthetic oligonucleotide
ggaatttaccaaaaacagtt

SEQ ID NO: 426 - DNA, 20 bp, Artificial sequence
  Synthetic oligonucleotide
agttaggtattgtccatttt

SEQ ID NO: 427 - DNA, 20 bp, Artificial sequence
  Synthetic oligonucleotide
acatgggtatcttctaggaa

SEQ ID NO: 428 - DNA, 20 bp, Artificial sequence
  Synthetic oligonucleotide
tcagtttcagagagacaaaa

SEQ ID NO: 429 - DNA, 20 bp, Artificial sequence
  Synthetic oligonucleotide
tttgccaggtcctatgtcga

SEQ ID NO: 430 - DNA, 20 bp, Artificial sequence
  Synthetic oligonucleotide
attcccttttctctacaacc

SEQ ID NO: 431 - DNA, 20 bp, Artificial sequence
  Synthetic oligonucleotide
atgataagagccaagatttg

SEQ ID NO: 432 - DNA, 20 bp, Artificial sequence
  Synthetic oligonucleotide
gaaaaaaggtccactgtggt

SEQ ID NO: 433 - DNA, 20 bp, Artificial sequence
  Synthetic oligonucleotide
cctgtcctggaatagtttca

SEQ ID NO: 434 - DNA, 20 bp, Artificial sequence
  Synthetic oligonucleotide
tagaaaagtaaataaggaat

SEQ ID NO: 435 - DNA, 20 bp, Artificial sequence
  Synthetic oligonucleotide
ttataaaactatgcaatagg

SEQ ID NO: 436 - DNA, 20 bp, Artificial sequence
  Synthetic oligonucleotide
ttatttcatatttccagaaa

SEQ ID NO: 437 - DNA, 20 bp, Artificial sequence
  Synthetic oligonucleotide
catgaattacagctaaagat

SEQ ID NO: 438 - DNA, 20 bp, Artificial sequence
  Synthetic oligonucleotide
ttgcatgtatgtgtttctga

SEQ ID NO: 439 - DNA, 20 bp, Artificial sequence
  Synthetic oligonucleotide
tcaatctctttataccctta

SEQ ID NO: 440 - DNA, 20 bp, Artificial sequence
  Synthetic oligonucleotide
tcttcaatctctttataccc

SEQ ID NO: 441 - DNA, 20 bp, Artificial sequence
  Synthetic oligonucleotide
ctatgccctagttacttcta

SEQ ID NO: 442 - DNA, 20 bp, Artificial sequence
  Synthetic oligonucleotide
aaagagaatctcttcctttt

SEQ ID NO: 443 - DNA, 20 bp, Artificial sequence
  Synthetic oligonucleotide
tcattaaagattattataac

SEQ ID NO: 444 - DNA, 20 bp, Artificial sequence
  Synthetic oligonucleotide
tttggatgagtggaaggcta

SEQ ID NO: 445 - DNA, 20 bp, Artificial sequence
  Synthetic oligonucleotide
ggaaatggcctttttcctta

SEQ ID NO: 446 - DNA, 20 bp, Artificial sequence
  Synthetic oligonucleotide
ggagaagccctctgcctgta

SEQ ID NO: 447 - DNA, 20 bp, Artificial sequence
  Synthetic oligonucleotide
aaaccatattgtccaccaga

SEQ ID NO: 448 - DNA, 20 bp, Artificial sequence
  Synthetic oligonucleotide
ctcaaaccatattgtccacc

SEQ ID NO: 449 - DNA, 20 bp, Artificial sequence
  Synthetic oligonucleotide
gtgtaaatagtgacttgtac

SEQ ID NO: 450 - DNA, 20 bp, Artificial sequence
  Synthetic oligonucleotide
tgaggcacaggaaagttaac

SEQ ID NO: 451 - DNA, 20 bp, Artificial sequence
  Synthetic oligonucleotide
agctatagttctccattagg

SEQ ID NO: 452 - DNA, 20 bp, Artificial sequence
  Synthetic oligonucleotide
ttacttgctgactaagccat

SEQ ID NO: 453 - DNA, 20 bp, Artificial sequence
  Synthetic oligonucleotide
gtttgtcaactcaacatcaa

SEQ ID NO: 454 - DNA, 20 bp, Artificial sequence
  Synthetic oligonucleotide
gactatttgtatatatatac

SEQ ID NO: 455 - DNA, 20 bp, Artificial sequence
  Synthetic oligonucleotide
atgactatttgtatatatat

SEQ ID NO: 456 - DNA, 20 bp, Artificial sequence
  Synthetic oligonucleotide
actcttccttatatttgctc

SEQ ID NO: 457 - DNA, 20 bp, Artificial sequence
  Synthetic oligonucleotide
atacactgacttttaacatt

SEQ ID NO: 458 - DNA, 20 bp, Artificial sequence
  Synthetic oligonucleotide
cttagaaacagtagtttcat

SEQ ID NO: 459 - DNA, 20 bp, Artificial sequence
  Synthetic oligonucleotide
ctgagctttgccttaagaat

SEQ ID NO: 460 - DNA, 20 bp, Artificial sequence
  Synthetic oligonucleotide
caccagacagcaggtagagc

SEQ ID NO: 461 - DNA, 20 bp, Artificial sequence
  Synthetic oligonucleotide
gagatggagtagaaggcaaa

SEQ ID NO: 462 - DNA, 20 bp, Artificial sequence
  Synthetic oligonucleotide
taggaaaggaagaatacact

SEQ ID NO: 463 - DNA, 20 bp, Artificial sequence
  Synthetic oligonucleotide
tagaccaggaagggtgagag

SEQ ID NO: 464 - DNA, 20 bp, Artificial sequence
  Synthetic oligonucleotide
aagttggatctggcatgcat

SEQ ID NO: 465 - DNA, 20 bp, Artificial sequence
  Synthetic oligonucleotide
aaagttggatctggcatgca

SEQ ID NO: 466 - DNA, 20 bp, Artificial sequence
  Synthetic oligonucleotide
ccataactcttctaactggg

SEQ ID NO: 467 - DNA, 20 bp, Artificial sequence
  Synthetic oligonucleotide
atattaaagtttgagaacta

SEQ ID NO: 468 - DNA, 20 bp, Artificial sequence
  Synthetic oligonucleotide
cttaactacaaaatgctgga

SEQ ID NO: 469 - DNA, 20 bp, Artificial sequence
  Synthetic oligonucleotide
tgagcagctgtcctcagttc

SEQ ID NO: 470 - DNA, 20 bp, Artificial sequence
  Synthetic oligonucleotide
gagttcataaaagttttact

SEQ ID NO: 471 - DNA, 20 bp, Artificial sequence
  Synthetic oligonucleotide
ctatccacaccattccataa

SEQ ID NO: 472 - DNA, 20 bp, Artificial sequence
  Synthetic oligonucleotide
aacatctaagtaatgcaaac

SEQ ID NO: 473 - DNA, 20 bp, Artificial sequence
  Synthetic oligonucleotide
tttgcattcaaagccctggg

SEQ ID NO: 474 - DNA, 20 bp, Artificial sequence
  Synthetic oligonucleotide
tccatattataggctatgat

SEQ ID NO: 475 - DNA, 20 bp, Artificial sequence
  Synthetic oligonucleotide
attttatgataatgtaaaac

SEQ ID NO: 476 - DNA, 20 bp, Artificial sequence
  Synthetic oligonucleotide
gagatcacattttctgagta

SEQ ID NO: 477 - DNA, 20 bp, Artificial sequence
  Synthetic oligonucleotide
acctccctaggattacctca

SEQ ID NO: 478 - DNA, 20 bp, Artificial sequence
  Synthetic oligonucleotide
aaaatctgatttataatcaa

SEQ ID NO: 479 - DNA, 20 bp, Artificial sequence
  Synthetic oligonucleotide
agcatagattttgacttccc

SEQ ID NO: 480 - DNA, 20 bp, Artificial sequence
  Synthetic oligonucleotide
aaagtcatatacacaggtct

SEQ ID NO: 481 - DNA, 20 bp, Artificial sequence
  Synthetic oligonucleotide
ctcatagcaaattcccagaa

SEQ ID NO: 482 - DNA, 20 bp, Artificial sequence
  Synthetic oligonucleotide
caacatggaggctagcatgt

SEQ ID NO: 483 - DNA, 20 bp, Artificial sequence
  Synthetic oligonucleotide
agactaagtggcctgaatgt

SEQ ID NO: 484 - DNA, 20 bp, Artificial sequence
  Synthetic oligonucleotide
acctaccatgtcactctcaa

SEQ ID NO: 485 - DNA, 20 bp, Artificial sequence
  Synthetic oligonucleotide
aactttcttgtgttttatca

SEQ ID NO: 486 - DNA, 20 bp, Artificial sequence
  Synthetic oligonucleotide
tttgcaagacaaagaaatga

SEQ ID NO: 487 - DNA, 20 bp, Artificial sequence
  Synthetic oligonucleotide
catgcaaagtgttcctcttc

SEQ ID NO: 488 - DNA, 20 bp, Artificial sequence
  Synthetic oligonucleotide
agtgctttgctttctcttat

SEQ ID NO: 489 - DNA, 20 bp, Artificial sequence
  Synthetic oligonucleotide
gaacaagaaacacttggtaa

SEQ ID NO: 490 - DNA, 20 bp, Artificial sequence
  Synthetic oligonucleotide
agtgttccaattaaatggca

SEQ ID NO: 491 - DNA, 20 bp, Artificial sequence
  Synthetic oligonucleotide
aaacaatgcccttgtagtga

SEQ ID NO: 492 - DNA, 20 bp, Artificial sequence
  Synthetic oligonucleotide
tattctaggttttgaggtga

SEQ ID NO: 493 - DNA, 20 bp, Artificial sequence
  Synthetic oligonucleotide
atattctaggttttgaggtg

SEQ ID NO: 494 - DNA, 20 bp, Artificial sequence
  Synthetic oligonucleotide
gttttccattctttaagaaa

SEQ ID NO: 495 - DNA, 20 bp, Artificial sequence
  Synthetic oligonucleotide
agcaatccattgattgtatg

SEQ ID NO: 496 - DNA, 20 bp, Artificial sequence
  Synthetic oligonucleotide
aattatggcaaaatggaaaa

SEQ ID NO: 497 - DNA, 20 bp, Artificial sequence
  Synthetic oligonucleotide
acatttgcttatgagactat

SEQ ID NO: 498 - DNA, 20 bp, Artificial sequence
  Synthetic oligonucleotide
gcagagataatcctatgatg

SEQ ID NO: 499 - DNA, 20 bp, Artificial sequence
  Synthetic oligonucleotide
tccatctgttacctctctgt

SEQ ID NO: 500 - DNA, 20 bp, Artificial sequence
  Synthetic oligonucleotide
tttgcctgaagggcagaacc

SEQ ID NO: 501 - DNA, 20 bp, Artificial sequence
  Synthetic oligonucleotide
gaaaaaatcagattttcaca

SEQ ID NO: 502 - DNA, 20 bp, Artificial sequence
  Synthetic oligonucleotide
aacttaatttaatcatttct

SEQ ID NO: 503 - DNA, 20 bp, Artificial sequence
  Synthetic oligonucleotide
tttggttgtcatgagttgag

SEQ ID NO: 504 - DNA, 20 bp, Artificial sequence
  Synthetic oligonucleotide
ttccatctctagggcacttt

SEQ ID NO: 505 - DNA, 20 bp, Artificial sequence
  Synthetic oligonucleotide
agagcttattttcaaaattc

SEQ ID NO: 506 - DNA, 20 bp, Artificial sequence
  Synthetic oligonucleotide
ataaagagcaaacaaacata

SEQ ID NO: 507 - DNA, 20 bp, Artificial sequence
  Synthetic oligonucleotide
tataaattccttggtctgat

SEQ ID NO: 508 - DNA, 20 bp, Artificial sequence
  Synthetic oligonucleotide
aaaatataaattccttggtc

SEQ ID NO: 509 - DNA, 20 bp, Artificial sequence
  Synthetic oligonucleotide
ttttataacagcctctgaca

SEQ ID NO: 510 - DNA, 20 bp, Artificial sequence
  Synthetic oligonucleotide
aaaagaccatgttgcttatt

SEQ ID NO: 511 - DNA, 20 bp, Artificial sequence
  Synthetic oligonucleotide
atagtcagtcagaatgtggt

SEQ ID NO: 512 - DNA, 20 bp, Artificial sequence
  Synthetic oligonucleotide
tgccttagcttggaaaagac

SEQ ID NO: 513 - DNA, 20 bp, Artificial sequence
  Synthetic oligonucleotide
agggctagctgatgcctctc

SEQ ID NO: 514 - DNA, 20 bp, Artificial sequence
  Synthetic oligonucleotide
ttggactgggctcaaacaga

SEQ ID NO: 515 - DNA, 20 bp, Artificial sequence
  Synthetic oligonucleotide
aaagtcaggctagagggact

SEQ ID NO: 516 - DNA, 20 bp, Artificial sequence
  Synthetic oligonucleotide
tccttgttttcttgtaatga

SEQ ID NO: 517 - DNA, 20 bp, Artificial sequence
  Synthetic oligonucleotide
acaccagaggaaggaaatca

SEQ ID NO: 518 - DNA, 20 bp, Artificial sequence
  Synthetic oligonucleotide
gatgtacaccattttgaatt

SEQ ID NO: 519 - DNA, 20 bp, Artificial sequence
  Synthetic oligonucleotide
tgctctggcctagcctatgt

SEQ ID NO: 520 - DNA, 20 bp, Artificial sequence
  Synthetic oligonucleotide
cagaggtgtctcccaagaaa

SEQ ID NO: 521 - DNA, 20 bp, Artificial sequence
  Synthetic oligonucleotide
aaagagaatggatcaaagct

SEQ ID NO: 522 - DNA, 20 bp, Artificial sequence
  Synthetic oligonucleotide
gatttgcagaacaaatcttg

SEQ ID NO: 523 - DNA, 20 bp, Artificial sequence
  Synthetic oligonucleotide
tggttatgaaggttggacca

SEQ ID NO: 524 - DNA, 20 bp, Artificial sequence
  Synthetic oligonucleotide
tggctaattaatgggcaatt

SEQ ID NO: 525 - DNA, 20 bp, Artificial sequence
  Synthetic oligonucleotide
ctgtgccatattgcctctaa

SEQ ID NO: 526 - DNA, 20 bp, Artificial sequence
  Synthetic oligonucleotide
gatttcaaccagctcacctg

SEQ ID NO: 527 - DNA, 20 bp, Artificial sequence
  Synthetic oligonucleotide
gcaaaagggaaccctgaagc

SEQ ID NO: 528 - DNA, 20 bp, Artificial sequence
  Synthetic oligonucleotide
ctaagtgttataacaaacac

SEQ ID NO: 529 - DNA, 20 bp, Artificial sequence
  Synthetic oligonucleotide
gtccattggtataaaactca

SEQ ID NO: 530 - DNA, 20 bp, Artificial sequence
  Synthetic oligonucleotide
tttcaatacaataagattta

SEQ ID NO: 531 - DNA, 20 bp, Artificial sequence
  Synthetic oligonucleotide
gtccttagacccctcaatgg

SEQ ID NO: 532 - DNA, 20 bp, Artificial sequence
  Synthetic oligonucleotide
gaggatttattcatctaggc

SEQ ID NO: 533 - DNA, 20 bp, Artificial sequence
  Synthetic oligonucleotide
cagtgggaggatcagatatc

SEQ ID NO: 534 - DNA, 20 bp, Artificial sequence
  Synthetic oligonucleotide
atcccatccagcagctggac

SEQ ID NO: 535 - DNA, 20 bp, Artificial sequence
  Synthetic oligonucleotide
aacttgggatgagttactga

SEQ ID NO: 536 - DNA, 20 bp, Artificial sequence
  Synthetic oligonucleotide
gaaggctacctaaaagaaat

SEQ ID NO: 537 - DNA, 20 bp, Artificial sequence
  Synthetic oligonucleotide
aaagaaatattcacaacatt

SEQ ID NO: 538 - DNA, 20 bp, Artificial sequence
  Synthetic oligonucleotide
atgcttatactgctgctgta

SEQ ID NO: 539 - DNA, 20 bp, Artificial sequence
  Synthetic oligonucleotide
tcctcacttcaatcaccttt

SEQ ID NO: 540 - DNA, 20 bp, Artificial sequence
  Synthetic oligonucleotide
ctctttcttcataaataagt

SEQ ID NO: 541 - DNA, 20 bp, Artificial sequence
  Synthetic oligonucleotide
tggtaatctgtgtcccttta

SEQ ID NO: 542 - DNA, 20 bp, Artificial sequence
  Synthetic oligonucleotide
taataaaaaagtttgaaaca

SEQ ID NO: 543 - DNA, 20 bp, Artificial sequence
  Synthetic oligonucleotide
ggtggtggcaagagaaaaat

SEQ ID NO: 544 - DNA, 20 bp, Artificial sequence
  Synthetic oligonucleotide
caaaaggccctttttacatg

SEQ ID NO: 545 - DNA, 20 bp, Artificial sequence
  Synthetic oligonucleotide
actctactggtaccaattta

SEQ ID NO: 546 - DNA, 20 bp, Artificial sequence
  Synthetic oligonucleotide
tctgaacttttatgctctgt

SEQ ID NO: 547 - DNA, 20 bp, Artificial sequence
  Synthetic oligonucleotide
aacttttgcctgggcatcca

SEQ ID NO: 548 - DNA, 20 bp, Artificial sequence
  Synthetic oligonucleotide
tgactccatgtctcacatcc

SEQ ID NO: 549 - DNA, 20 bp, Artificial sequence
  Synthetic oligonucleotide
ttacttcctagatacaacag

SEQ ID NO: 550 - DNA, 20 bp, Artificial sequence
  Synthetic oligonucleotide
ctggcccccatgattcaatt

SEQ ID NO: 551 - DNA, 20 bp, Artificial sequence
  Synthetic oligonucleotide
aagactggcccccatgattc

SEQ ID NO: 552 - DNA, 20 bp, Artificial sequence
  Synthetic oligonucleotide
tgtcactggtctgtgtattt

SEQ ID NO: 553 - DNA, 20 bp, Artificial sequence
  Synthetic oligonucleotide
acagagtagatttagcataa

SEQ ID NO: 554 - DNA, 20 bp, Artificial sequence
  Synthetic oligonucleotide
taaacaggtgtactattaca

SEQ ID NO: 555 - DNA, 20 bp, Artificial sequence
  Synthetic oligonucleotide
gctttatcaactaagtttat

SEQ ID NO: 556 - DNA, 20 bp, Artificial sequence
  Synthetic oligonucleotide
cagaacttcttttaaaattg

SEQ ID NO: 557 - DNA, 20 bp, Artificial sequence
  Synthetic oligonucleotide
gaatacagacataccttgaa

SEQ ID NO: 558 - DNA, 20 bp, Artificial sequence
  Synthetic oligonucleotide
ccatgacaacaatttcagag

SEQ ID NO: 559 - DNA, 20 bp, Artificial sequence
  Synthetic oligonucleotide
acaaatagcaatgaatgggt

SEQ ID NO: 560 - DNA, 20 bp, Artificial sequence
  Synthetic oligonucleotide
caacaaatagcaatgaatgg

SEQ ID NO: 561 - DNA, 20 bp, Artificial sequence
  Synthetic oligonucleotide
gtacacaaatcagtagctct

SEQ ID NO: 562 - DNA, 20 bp, Artificial sequence
  Synthetic oligonucleotide
ctatgtcaaaaagactgaaa

SEQ ID NO: 563 - DNA, 20 bp, Artificial sequence
  Synthetic oligonucleotide
atatacagaacatttcatcc

SEQ ID NO: 564 - DNA, 20 bp, Artificial sequence
  Synthetic oligonucleotide
agaatagataagaactcacc

SEQ ID NO: 565 - DNA, 20 bp, Artificial sequence
  Synthetic oligonucleotide
aggaaagatacagtcatttt

SEQ ID NO: 566 - DNA, 20 bp, Artificial sequence
  Synthetic oligonucleotide
gcacaaagaacacctgggaa

SEQ ID NO: 567 - DNA, 20 bp, Artificial sequence
  Synthetic oligonucleotide
caagaagtctgggattatgt

SEQ ID NO: 568 - DNA, 20 bp, Artificial sequence
  Synthetic oligonucleotide
gttagttattaagctaatca

SEQ ID NO: 569 - DNA, 20 bp, Artificial sequence
  Synthetic oligonucleotide
aaccattatttataggctaa

SEQ ID NO: 570 - DNA, 20 bp, Artificial sequence
  Synthetic oligonucleotide
ccagaatgcgatcacttctt

SEQ ID NO: 571 - DNA, 20 bp, Artificial sequence
  Synthetic oligonucleotide
ccagaaattatcctcctctc

SEQ ID NO: 572 - DNA, 20 bp, Artificial sequence
  Synthetic oligonucleotide
agggaaatgcaaattaaaac

SEQ ID NO: 573 - DNA, 20 bp, Artificial sequence
  Synthetic oligonucleotide
gcatcaagatacagaaaaat

SEQ ID NO: 574 - DNA, 20 bp, Artificial sequence
  Synthetic oligonucleotide
gaatgtttatgagatttttc

SEQ ID NO: 575 - DNA, 20 bp, Artificial sequence
  Synthetic oligonucleotide
gccaattatattgccacatt

SEQ ID NO: 576 - DNA, 20 bp, Artificial sequence
  Synthetic oligonucleotide
atacttgcttatgtagaaat

SEQ ID NO: 577 - DNA, 20 bp, Artificial sequence
  Synthetic oligonucleotide
taatacttgcttatgtagaa

SEQ ID NO: 578 - DNA, 20 bp, Artificial sequence
  Synthetic oligonucleotide
gaacacatggcattctgata

SEQ ID NO: 579 - DNA, 20 bp, Artificial sequence
  Synthetic oligonucleotide
cagaatttgcagtataaatc

SEQ ID NO: 580 - DNA, 20 bp, Artificial sequence
  Synthetic oligonucleotide
tatgttttgaaatcttattt

SEQ ID NO: 581 - DNA, 20 bp, Artificial sequence
  Synthetic oligonucleotide
actcactgctacctcattaa

SEQ ID NO: 582 - DNA, 20 bp, Artificial sequence
  Synthetic oligonucleotide
aagcagtgatagggtatctg

SEQ ID NO: 583 - DNA, 20 bp, Artificial sequence
  Synthetic oligonucleotide
atgaggcctattacaatgga

SEQ ID NO: 584 - DNA, 20 bp, Artificial sequence
  Synthetic oligonucleotide
ctggagtctcatgaggccta

SEQ ID NO: 585 - DNA, 20 bp, Artificial sequence
  Synthetic oligonucleotide
tgactatcagccttttaatc

SEQ ID NO: 586 - DNA, 20 bp, Artificial sequence
  Synthetic oligonucleotide
ttcagagaacaacctttgaa

SEQ ID NO: 587 - DNA, 20 bp, Artificial sequence
  Synthetic oligonucleotide
agccatgtgtgatctgatgt

SEQ ID NO: 588 - DNA, 20 bp, Artificial sequence
  Synthetic oligonucleotide
gaaatttactccaaactagc

SEQ ID NO: 589 - DNA, 20 bp, Artificial sequence
  Synthetic oligonucleotide
aacatccagaccaccatcta

SEQ ID NO: 590 - DNA, 20 bp, Artificial sequence
  Synthetic oligonucleotide
gtaccaaaccattcatgctc

SEQ ID NO: 591 - DNA, 20 bp, Artificial sequence
  Synthetic oligonucleotide
agtaccaaaccattcatgct

SEQ ID NO: 592 - DNA, 20 bp, Artificial sequence
  Synthetic oligonucleotide
ttatagagcttgagattgac

SEQ ID NO: 593 - DNA, 20 bp, Artificial sequence
  Synthetic oligonucleotide
agtccattatagagcttgag

SEQ ID NO: 594 - DNA, 20 bp, Artificial sequence
  Synthetic oligonucleotide
aaccatgagatgcaatgcag

SEQ ID NO: 595 - DNA, 20 bp, Artificial sequence
  Synthetic oligonucleotide
aggattgagaatcgctgatt

SEQ ID NO: 596 - DNA, 20 bp, Artificial sequence
  Synthetic oligonucleotide
tctaaagcatggccaggatt

SEQ ID NO: 597 - DNA, 20 bp, Artificial sequence
  Synthetic oligonucleotide
gggactgagtattgatactt

SEQ ID NO: 598 - DNA, 20 bp, Artificial sequence
  Synthetic oligonucleotide
agaagtagggtgttccagat

SEQ ID NO: 599 - DNA, 20 bp, Artificial sequence
  Synthetic oligonucleotide
agaaatagtcttcctactaa

SEQ ID NO: 600 - DNA, 20 bp, Artificial sequence
  Synthetic oligonucleotide
gcctcctttaagcttctatg

SEQ ID NO: 601 - DNA, 20 bp, Artificial sequence
  Synthetic oligonucleotide
ggcctgcctttactttccca

SEQ ID NO: 602 - DNA, 20 bp, Artificial sequence
  Synthetic oligonucleotide
acctcagtggactctttcca

SEQ ID NO: 603 - DNA, 20 bp, Artificial sequence
  Synthetic oligonucleotide
caaacctaagttcaagtcct

SEQ ID NO: 604 - DNA, 20 bp, Artificial sequence
  Synthetic oligonucleotide
agtttcacttcttgaatcaa

SEQ ID NO: 605 - DNA, 20 bp, Artificial sequence
  Synthetic oligonucleotide
aagatcaaatgaggtcaagg

SEQ ID NO: 606 - DNA, 20 bp, Artificial sequence
  Synthetic oligonucleotide
tagatacaaatttcatcaca

SEQ ID NO: 607 - DNA, 20 bp, Artificial sequence
  Synthetic oligonucleotide
attcctaaaataggagcagg

SEQ ID NO: 608 - DNA, 20 bp, Artificial sequence
  Synthetic oligonucleotide
tttttatgttgtataagata

SEQ ID NO: 609 - DNA, 20 bp, Artificial sequence
  Synthetic oligonucleotide
gttcagccaatacatgagta

SEQ ID NO: 610 - DNA, 20 bp, Artificial sequence
  Synthetic oligonucleotide
ccagagggagttcattacca

SEQ ID NO: 611 - DNA, 20 bp, Artificial sequence
  Synthetic oligonucleotide
tctctctaattcaaccttat

SEQ ID NO: 612 - DNA, 20 bp, Artificial sequence
  Synthetic oligonucleotide
ataatcctcagacctcttta

SEQ ID NO: 613 - DNA, 20 bp, Artificial sequence
  Synthetic oligonucleotide
cactgtggcagaattccaag

SEQ ID NO: 614 - DNA, 20 bp, Artificial sequence
  Synthetic oligonucleotide
acaccttggtgcctagaagc

SEQ ID NO: 615 - DNA, 20 bp, Artificial sequence
  Synthetic oligonucleotide
gtagcaatgacacctaagaa

SEQ ID NO: 616 - DNA, 20 bp, Artificial sequence
  Synthetic oligonucleotide
tttaaaataataaatgctta

SEQ ID NO: 617 - DNA, 20 bp, Artificial sequence
  Synthetic oligonucleotide
tcatttggtccttagacccc

SEQ ID NO: 618 - DNA, 20 bp, Artificial sequence
  Synthetic oligonucleotide
ttattcatctaggccgagtg

SEQ ID NO: 619 - DNA, 20 bp, Artificial sequence
  Synthetic oligonucleotide
ttgcagaatcttctctttgg

SEQ ID NO: 620 - DNA, 20 bp, Artificial sequence
  Synthetic oligonucleotide
accataaagctatgccataa

SEQ ID NO: 621 - DNA, 20 bp, Artificial sequence
  Synthetic oligonucleotide
ggcaaggagcacaataggac

SEQ ID NO: 622 - DNA, 20 bp, Artificial sequence
  Synthetic oligonucleotide
acccaaaaagttgagctgag

SEQ ID NO: 623 - DNA, 20 bp, Artificial sequence
  Synthetic oligonucleotide
tagattttcagactctttct

SEQ ID NO: 624 - DNA, 20 bp, Artificial sequence
  Synthetic oligonucleotide
aatttcaatattgttgtgtt

SEQ ID NO: 625 - DNA, 20 bp, Artificial sequence
  Synthetic oligonucleotide
atgcttttaatggcacccaa

SEQ ID NO: 626 - DNA, 20 bp, Artificial sequence
  Synthetic oligonucleotide
catgtctcacatccaggtca

SEQ ID NO: 627 - DNA, 20 bp, Artificial sequence
  Synthetic oligonucleotide
ttcactggagtagactttta

SEQ ID NO: 628 - DNA, 20 bp, Artificial sequence
  Synthetic oligonucleotide
cttataagggaggtctggta

SEQ ID NO: 629 - DNA, 20 bp, Artificial sequence
  Synthetic oligonucleotide
gcataattcttaagggccct

SEQ ID NO: 630 - DNA, 20 bp, Artificial sequence
  Synthetic oligonucleotide
ccacagaacttcttttaaaa

SEQ ID NO: 631 - DNA, 20 bp, Artificial sequence
  Synthetic oligonucleotide
ggtgaccatgattttaacaa

SEQ ID NO: 632 - DNA, 20 bp, Artificial sequence
  Synthetic oligonucleotide
aacagctgcatgacaatttt

SEQ ID NO: 633 - DNA, 20 bp, Artificial sequence
  Synthetic oligonucleotide
agaaacagaatcagtgactt

SEQ ID NO: 634 - DNA, 20 bp, Artificial sequence
  Synthetic oligonucleotide
cagattccagagaaaagcca

SEQ ID NO: 635 - DNA, 20 bp, Artificial sequence
  Synthetic oligonucleotide
tgtgagaagaactctatcac

SEQ ID NO: 636 - DNA, 20 bp, Artificial sequence
  Synthetic oligonucleotide
ctcacaaatcaccactaaag

SEQ ID NO: 637 - DNA, 20 bp, Artificial sequence
  Synthetic oligonucleotide
caacgagtggataaagaaac

SEQ ID NO: 638 - DNA, 20 bp, Artificial sequence
  Synthetic oligonucleotide
ataaaactggatcctcatct

SEQ ID NO: 639 - DNA, 20 bp, Artificial sequence
  Synthetic oligonucleotide
attaaaactctcagcaaaat

SEQ ID NO: 640 - DNA, 20 bp, Artificial sequence
  Synthetic oligonucleotide
aaagactgaaagaacacaaa

SEQ ID NO: 641 - DNA, 20 bp, Artificial sequence
  Synthetic oligonucleotide
tatctgctgccttcaggaga

SEQ ID NO: 642 - DNA, 20 bp, Artificial sequence
  Synthetic oligonucleotide
tttgaattaacccaattcaa

SEQ ID NO: 643 - DNA, 20 bp, Artificial sequence
  Synthetic oligonucleotide
tcttaatttacaacagagga

SEQ ID NO: 644 - DNA, 20 bp, Artificial sequence
  Synthetic oligonucleotide
agaaaagtgacaggcttccc

SEQ ID NO: 645 - DNA, 20 bp, Artificial sequence
  Synthetic oligonucleotide
atgttccttgaagatcccaa

SEQ ID NO: 646 - DNA, 20 bp, Artificial sequence
  Synthetic oligonucleotide
atgaataacacttgccacaa

SEQ ID NO: 647 - DNA, 20 bp, Artificial sequence
  Synthetic oligonucleotide
gtatgtttatcacagcacag

SEQ ID NO: 648 - DNA, 20 bp, Artificial sequence
  Synthetic oligonucleotide
aaacactgcaatattaggtt

SEQ ID NO: 649 - DNA, 20 bp, Artificial sequence
  Synthetic oligonucleotide
gattggtgcttttcaaactg

SEQ ID NO: 650 - DNA, 20 bp, Artificial sequence
  Synthetic oligonucleotide
atttgtaagacaaacatgaa

SEQ ID NO: 651 - DNA, 20 bp, Artificial sequence
  Synthetic oligonucleotide
tcacatgactatgttctggc

SEQ ID NO: 652 - DNA, 20 bp, Artificial sequence
  Synthetic oligonucleotide
agtcctgtccacactattaa

SEQ ID NO: 653 - DNA, 20 bp, Artificial sequence
  Synthetic oligonucleotide
ctgggctctgcctgctgaac

SEQ ID NO: 654 - DNA, 20 bp, Artificial sequence
  Synthetic oligonucleotide
aaaacccttaagtatttcct

SEQ ID NO: 655 - DNA, 20 bp, Artificial sequence
  Synthetic oligonucleotide
ctctgtttcaaaccccccag

SEQ ID NO: 656 - DNA, 20 bp, Artificial sequence
  Synthetic oligonucleotide
ggacagaacaccaatcacaa

SEQ ID NO: 657 - DNA, 20 bp, Artificial sequence
  Synthetic oligonucleotide
acctacccttcaaagtcacg

SEQ ID NO: 658 - DNA, 20 bp, Artificial sequence
  Synthetic oligonucleotide
ttcagttcccaggaggctta

SEQ ID NO: 659 - DNA, 20 bp, Artificial sequence
  Synthetic oligonucleotide
ttttgcaatgtctagcaatt

SEQ ID NO: 660 - DNA, 20 bp, Artificial sequence
  Synthetic oligonucleotide
attaagatcagaaaatatta

SEQ ID NO: 661 - DNA, 20 bp, Artificial sequence
  Synthetic oligonucleotide
ttaatgagatattttgcacc

SEQ ID NO: 662 - DNA, 20 bp, Artificial sequence
  Synthetic oligonucleotide
gagaggttaagtaaatctcc

SEQ ID NO: 663 - DNA, 20 bp, Artificial sequence
  Synthetic oligonucleotide
cagactcaaatttgaaaatt

SEQ ID NO: 664 - DNA, 20 bp, Artificial sequence
  Synthetic oligonucleotide
gataaggcaataatacagcc

SEQ ID NO: 665 - DNA, 20 bp, Artificial sequence
  Synthetic oligonucleotide
atcatttgccaatttctgtg

SEQ ID NO: 666 - DNA, 20 bp, Artificial sequence
  Synthetic oligonucleotide
caagaagaaaagatgcaaaa

SEQ ID NO: 667 - DNA, 20 bp, Artificial sequence
  Synthetic oligonucleotide
aatttatttccttcctatga

SEQ ID NO: 668 - DNA, 20 bp, Artificial sequence
  Synthetic oligonucleotide
ttttggaaatgtgagaaacg

SEQ ID NO: 669 - DNA, 20 bp, Artificial sequence
  Synthetic oligonucleotide
aaacacatgagaaaagatga

SEQ ID NO: 670 - DNA, 20 bp, Artificial sequence
  Synthetic oligonucleotide
tgttggctcagtgggaatga

SEQ ID NO: 671 - DNA, 20 bp, Artificial sequence
  Synthetic oligonucleotide
tgaacaggtttgcatttctc

SEQ ID NO: 672 - DNA, 20 bp, Artificial sequence
  Synthetic oligonucleotide
tcctaggtgaacaggctatg

SEQ ID NO: 673 - DNA, 20 bp, Artificial sequence
  Synthetic oligonucleotide
ccctaatcaggctgaaataa

SEQ ID NO: 674 - DNA, 20 bp, Artificial sequence
  Synthetic oligonucleotide
agggccagtaaggtttgctt

SEQ ID NO: 675 - DNA, 20 bp, Artificial sequence
  Synthetic oligonucleotide
agcctgaattctgagctctg

SEQ ID NO: 676 - DNA, 20 bp, Artificial sequence
  Synthetic oligonucleotide
agaggatctcagctgcaatt

SEQ ID NO: 677 - DNA, 20 bp, Artificial sequence
  Synthetic oligonucleotide
gaaaatccctgctcaagtgc

SEQ ID NO: 678 - DNA, 20 bp, Artificial sequence
  Synthetic oligonucleotide
tgcctgatattgtaattctt

SEQ ID NO: 679 - DNA, 20 bp, Artificial sequence
  Synthetic oligonucleotide
ctcatacagtgaagtcttca

SEQ ID NO: 680 - DNA, 20 bp, Artificial sequence
  Synthetic oligonucleotide
ctcactaagcttgattcact

SEQ ID NO: 681 - DNA, 20 bp, Artificial sequence
  Synthetic oligonucleotide
gatacagaaatcccagtgac

SEQ ID NO: 682 - DNA, 20 bp, Artificial sequence
  Synthetic oligonucleotide
tgtgcttgggtgtacaggca

SEQ ID NO: 683 - DNA, 20 bp, Artificial sequence
  Synthetic oligonucleotide
tcaagcacttacatcatatg

SEQ ID NO: 684 - DNA, 20 bp, Artificial sequence
  Synthetic oligonucleotide
agggttagttattacactta

SEQ ID NO: 685 - DNA, 20 bp, Artificial sequence
  Synthetic oligonucleotide
aggcttcatgtgaggtaaca

SEQ ID NO: 686 - DNA, 20 bp, Artificial sequence
  Synthetic oligonucleotide
tgaaagcttagtacaagaag

SEQ ID NO: 687 - DNA, 20 bp, Artificial sequence
  Synthetic oligonucleotide
ctctcctcttggagatccag

SEQ ID NO: 688 - DNA, 20 bp, Artificial sequence
  Synthetic oligonucleotide
gctgagatttctctcctctt

SEQ ID NO: 689 - DNA, 20 bp, Artificial sequence
  Synthetic oligonucleotide
cttttgctgagatttctctc

SEQ ID NO: 690 - DNA, 20 bp, Artificial sequence
  Synthetic oligonucleotide
gaacatatgtccatagaatg

SEQ ID NO: 691 - DNA, 20 bp, Artificial sequence
  Synthetic oligonucleotide
gaacaggctatgtaatcaaa

SEQ ID NO: 692 - DNA, 20 bp, Artificial sequence
  Synthetic oligonucleotide
tttttattactgtgcaaacc

SEQ ID NO: 693 - DNA, 20 bp, Artificial sequence
  Synthetic oligonucleotide
actgagggtggaaatggaaa

SEQ ID NO: 694 - DNA, 20 bp, Artificial sequence
  Synthetic oligonucleotide
atgccatacttttcatttca

SEQ ID NO: 695 - DNA, 20 bp, Artificial sequence
  Synthetic oligonucleotide
tctttaaagatttcctatgc

SEQ ID NO: 696 - DNA, 20 bp, Artificial sequence
  Synthetic oligonucleotide
tcacaattaaattatgttta

SEQ ID NO: 697 - DNA, 20 bp, Artificial sequence
  Synthetic oligonucleotide
tttgccatcaccaaacacca

SEQ ID NO: 698 - DNA, 20 bp, Artificial sequence
  Synthetic oligonucleotide
tcagaatgctgaaggatggg

SEQ ID NO: 699 - DNA, 20 bp, Artificial sequence
  Synthetic oligonucleotide
acaattgcaggagagaactg

SEQ ID NO: 700 - DNA, 20 bp, Artificial sequence
  Synthetic oligonucleotide
gttcagtcacctggaaagag

SEQ ID NO: 701 - DNA, 20 bp, Artificial sequence
  Synthetic oligonucleotide
cggagttcagtcacctggaa

SEQ ID NO: 702 - DNA, 20 bp, Artificial sequence
  Synthetic oligonucleotide
aatctaaagttcaatgtcca

SEQ ID NO: 703 - DNA, 20 bp, Artificial sequence
  Synthetic oligonucleotide
ccacctttgggtgaatagca

SEQ ID NO: 704 - DNA, 20 bp, Artificial sequence
  Synthetic oligonucleotide
caacatcaaaagtttccacc

SEQ ID NO: 705 - DNA, 20 bp, Artificial sequence
  Synthetic oligonucleotide
aagcttctatcaaccaactg

SEQ ID NO: 706 - DNA, 20 bp, Artificial sequence
  Synthetic oligonucleotide
accattttctaataattcac

SEQ ID NO: 707 - DNA, 20 bp, Artificial sequence
  Synthetic oligonucleotide
acctgcacttggacaactga

SEQ ID NO: 708 - DNA, 20 bp, Artificial sequence
  Synthetic oligonucleotide
gtcagtgctttggtgatgta

SEQ ID NO: 709 - DNA, 20 bp, Artificial sequence
  Synthetic oligonucleotide
tagaagcacaggaactagag

SEQ ID NO: 710 - DNA, 20 bp, Artificial sequence
  Synthetic oligonucleotide
tttaattttattagaagcac

SEQ ID NO: 711 - DNA, 20 bp, Artificial sequence
  Synthetic oligonucleotide
gagcaagaattaagaaaatc

SEQ ID NO: 712 - DNA, 20 bp, Artificial sequence
  Synthetic oligonucleotide
ctctgcagtcatgtacacaa

SEQ ID NO: 713 - DNA, 20 bp, Artificial sequence
  Synthetic oligonucleotide
gcttggtttgtcaatccttt

SEQ ID NO: 714 - DNA, 20 bp, Artificial sequence
  Synthetic oligonucleotide
gttctcaagcaggagccatt

SEQ ID NO: 715 - DNA, 20 bp, Artificial sequence
  Synthetic oligonucleotide
agggtgatcttccaaaacaa

SEQ ID NO: 716 - DNA, 20 bp, Artificial sequence
  Synthetic oligonucleotide
tctcctatgcttcctttaat

SEQ ID NO: 717 - DNA, 20 bp, Artificial sequence
  Synthetic oligonucleotide
gacataaatatgttcactga

SEQ ID NO: 718 - DNA, 20 bp, Artificial sequence
  Synthetic oligonucleotide
ttactgagtgacagtacagt

SEQ ID NO: 719 - DNA, 20 bp, Artificial sequence
  Synthetic oligonucleotide
ccaggcaccagcacaggcac

SEQ ID NO: 720 - DNA, 20 bp, Artificial sequence
  Synthetic oligonucleotide
ttaatgtcagtagaaagctg

SEQ ID NO: 721 - DNA, 20 bp, Artificial sequence
  Synthetic oligonucleotide
gcaggtggaaagaagatgtc

SEQ ID NO: 722 - DNA, 20 bp, Artificial sequence
  Synthetic oligonucleotide
gccagggtctttacaaagtt

SEQ ID NO: 723 - DNA, 20 bp, Artificial sequence
  Synthetic oligonucleotide
cattacctttgtacatgtac

SEQ ID NO: 724 - DNA, 20 bp, Artificial sequence
  Synthetic oligonucleotide
gaagcaacttctctgaggtc

SEQ ID NO: 725 - DNA, 20 bp, Artificial sequence
  Synthetic oligonucleotide
gcctggcaagaagggccctt

SEQ ID NO: 726 - DNA, 20 bp, Artificial sequence
  Synthetic oligonucleotide
acacatgtttttaaatttat

SEQ ID NO: 727 - DNA, 20 bp, Artificial sequence
  Synthetic oligonucleotide
tcacaatgcactaaaagaaa

SEQ ID NO: 728 - DNA, 20 bp, Artificial sequence
  Synthetic oligonucleotide
tcccaatgacttactgtaga

SEQ ID NO: 729 - DNA, 20 bp, Artificial sequence
  Synthetic oligonucleotide
taagcatttatggaggaatg

SEQ ID NO: 730 - DNA, 20 bp, Artificial sequence
  Synthetic oligonucleotide
tgaggtgggtggccaacagg

SEQ ID NO: 731 - DNA, 20 bp, Artificial sequence
  Synthetic oligonucleotide
gtttttcattttgattgcag

SEQ ID NO: 732 - DNA, 20 bp, Artificial sequence
  Synthetic oligonucleotide
agctcaagtgtttttcattt

SEQ ID NO: 733 - DNA, 20 bp, Artificial sequence
  Synthetic oligonucleotide
caatgtcacagctgtttcct

SEQ ID NO: 734 - DNA, 20 bp, Artificial sequence
  Synthetic oligonucleotide
gaactttggaggcttttaga

SEQ ID NO: 735 - DNA, 20 bp, Artificial sequence
  Synthetic oligonucleotide
tgtatgccccaaactcccat

SEQ ID NO: 736 - DNA, 20 bp, Artificial sequence
  Synthetic oligonucleotide
acacaaataagggaataata

SEQ ID NO: 737 - DNA, 20 bp, Artificial sequence
  Synthetic oligonucleotide
tagttcagccactatggaaa

SEQ ID NO: 738 - DNA, 20 bp, Artificial sequence
  Synthetic oligonucleotide
ctccaaattccagtcctagg

SEQ ID NO: 739 - DNA, 20 bp, Artificial sequence
  Synthetic oligonucleotide
agttggcactgctatatcag

SEQ ID NO: 740 - DNA, 20 bp, Artificial sequence
  Synthetic oligonucleotide
ggccttagattgtaagtttt

SEQ ID NO: 741 - DNA, 20 bp, Artificial sequence
  Synthetic oligonucleotide
ttttagtattattgtaggaa

SEQ ID NO: 742 - DNA, 20 bp, Artificial sequence
  Synthetic oligonucleotide
tttcattaatgaaacctgat

SEQ ID NO: 743 - DNA, 20 bp, Artificial sequence
  Synthetic oligonucleotide
ccctcagctgcctcttcaat

SEQ ID NO: 744 - DNA, 20 bp, Artificial sequence
  Synthetic oligonucleotide
tattgtatcctggcccctaa

SEQ ID NO: 745 - DNA, 20 bp, Artificial sequence
  Synthetic oligonucleotide
agaacaagagcctagaagta

SEQ ID NO: 746 - DNA, 20 bp, Artificial sequence
  Synthetic oligonucleotide
gtgactatgtcactgaattt

SEQ ID NO: 747 - DNA, 20 bp, Artificial sequence
  Synthetic oligonucleotide
gccctacccagcagcctgtg

SEQ ID NO: 748 - DNA, 20 bp, Artificial sequence
  Synthetic oligonucleotide
caaacataaagagagttcca

SEQ ID NO: 749 - DNA, 20 bp, Artificial sequence
  Synthetic oligonucleotide
ctttaaatgaagtagagctc

SEQ ID NO: 750 - DNA, 20 bp, Artificial sequence
  Synthetic oligonucleotide
ctgttcaaagaatgcaggcc

SEQ ID NO: 751 - DNA, 20 bp, Artificial sequence
  Synthetic oligonucleotide
gtctagcctaacagagatat

SEQ ID NO: 752 - DNA, 20 bp, Artificial sequence
  Synthetic oligonucleotide
aaagagtgatgtctagccta

SEQ ID NO: 753 - DNA, 20 bp, Artificial sequence
  Synthetic oligonucleotide
cacttcttactcctttgagg

SEQ ID NO: 754 - DNA, 20 bp, Artificial sequence
  Synthetic oligonucleotide
ttccacaagaaactcagttt

SEQ ID NO: 755 - DNA, 20 bp, Artificial sequence
  Synthetic oligonucleotide
agaaatgccaaagatagctc

SEQ ID NO: 756 - DNA, 20 bp, Artificial sequence
  Synthetic oligonucleotide
agcagaggatctcagctgca

SEQ ID NO: 757 - DNA, 20 bp, Artificial sequence
  Synthetic oligonucleotide
aatccctgctcaagtgctac

SEQ ID NO: 758 - DNA, 20 bp, Artificial sequence
  Synthetic oligonucleotide
aaatccctgctcaagtgcta

SEQ ID NO: 759 - DNA, 20 bp, Artificial sequence
  Synthetic oligonucleotide
aaaatccctgctcaagtgct

SEQ ID NO: 760 - DNA, 20 bp, Artificial sequence
  Synthetic oligonucleotide
agaaaatccctgctcaagtg

SEQ ID NO: 761 - DNA, 20 bp, Artificial sequence
  Synthetic oligonucleotide
aagaaaatccctgctcaagt

SEQ ID NO: 762 - DNA, 20 bp, Artificial sequence
  Synthetic oligonucleotide
caagaaaatccctgctcaag

SEQ ID NO: 763 - DNA, 20 bp, Artificial sequence
  Synthetic oligonucleotide
ctgatattgtaattcttggt

SEQ ID NO: 764 - DNA, 20 bp, Artificial sequence
  Synthetic oligonucleotide
cctgatattgtaattcttgg

SEQ ID NO: 765 - DNA, 20 bp, Artificial sequence
  Synthetic oligonucleotide
gcctgatattgtaattcttg

SEQ ID NO: 766 - DNA, 20 bp, Artificial sequence
  Synthetic oligonucleotide
atgcctgatattgtaattct

SEQ ID NO: 767 - DNA, 20 bp, Artificial sequence
  Synthetic oligonucleotide
aatgcctgatattgtaattc

SEQ ID NO: 768 - DNA, 20 bp, Artificial sequence
  Synthetic oligonucleotide
caatgcctgatattgtaatt

SEQ ID NO: 769 - DNA, 20 bp, Artificial sequence
  Synthetic oligonucleotide
aattatgtgctttgcctgca

SEQ ID NO: 770 - DNA, 20 bp, Artificial sequence
  Synthetic oligonucleotide
caattatgtgctttgcctgc

SEQ ID NO: 771 - DNA, 20 bp, Artificial sequence
  Synthetic oligonucleotide
tcaattatgtgctttgcctg

SEQ ID NO: 772 - DNA, 20 bp, Artificial sequence
  Synthetic oligonucleotide
tgtcaattatgtgctttgcc

SEQ ID NO: 773 - DNA, 20 bp, Artificial sequence
  Synthetic oligonucleotide
atgtcaattatgtgctttgc

SEQ ID NO: 774 - DNA, 20 bp, Artificial sequence
  Synthetic oligonucleotide
gatgtcaattatgtgctttg

SEQ ID NO: 775 - DNA, 20 bp, Artificial sequence
  Synthetic oligonucleotide
ctggtgactctgcctgatga

SEQ ID NO: 776 - DNA, 20 bp, Artificial sequence
  Synthetic oligonucleotide
gctggtgactctgcctgatg

SEQ ID NO: 777 - DNA, 20 bp, Artificial sequence
  Synthetic oligonucleotide
tgctggtgactctgcctgat

SEQ ID NO: 778 - DNA, 20 bp, Artificial sequence
  Synthetic oligonucleotide
gctgctggtgactctgcctg

SEQ ID NO: 779 - DNA, 20 bp, Artificial sequence
  Synthetic oligonucleotide
ggctgctggtgactctgcct

SEQ ID NO: 780 - DNA, 20 bp, Artificial sequence
  Synthetic oligonucleotide
tggctgctggtgactctgcc

SEQ ID NO: 781 - DNA, 20 bp, Artificial sequence
  Synthetic oligonucleotide
gctgaaggatgggcatccag

SEQ ID NO: 782 - DNA, 20 bp, Artificial sequence
  Synthetic oligonucleotide
tgctgaaggatgggcatcca

SEQ ID NO: 783 - DNA, 20 bp, Artificial sequence
  Synthetic oligonucleotide
atgctgaaggatgggcatcc

SEQ ID NO: 784 - DNA, 20 bp, Artificial sequence
  Synthetic oligonucleotide
gaatgctgaaggatgggcat

SEQ ID NO: 785 - DNA, 20 bp, Artificial sequence
  Synthetic oligonucleotide
agaatgctgaaggatgggca

SEQ ID NO: 786 - DNA, 20 bp, Artificial sequence
  Synthetic oligonucleotide
cagaatgctgaaggatgggc

SEQ ID NO: 787 - DNA, 20 bp, Artificial sequence
  Synthetic oligonucleotide
tccagtagtcaatattattt

SEQ ID NO: 788 - DNA, 20 bp, Artificial sequence
  Synthetic oligonucleotide
atccagtagtcaatattatt

SEQ ID NO: 789 - DNA, 20 bp, Artificial sequence
  Synthetic oligonucleotide
tatccagtagtcaatattat

SEQ ID NO: 790 - DNA, 20 bp, Artificial sequence
  Synthetic oligonucleotide
gttatccagtagtcaatatt

SEQ ID NO: 791 - DNA, 20 bp, Artificial sequence
  Synthetic oligonucleotide
ggttatccagtagtcaatat

SEQ ID NO: 792 - DNA, 20 bp, Artificial sequence
  Synthetic oligonucleotide
tggttatccagtagtcaata

SEQ ID NO: 793 - DNA, 20 bp, Artificial sequence
  Synthetic oligonucleotide
caacttgaggacaataagag

SEQ ID NO: 794 - DNA, 20 bp, Artificial sequence
  Synthetic oligonucleotide
tcaacttgaggacaataaga

SEQ ID NO: 795 - DNA, 20 bp, Artificial sequence
  Synthetic oligonucleotide
ctcaacttgaggacaataag

SEQ ID NO: 796 - DNA, 20 bp, Artificial sequence
  Synthetic oligonucleotide
aactcaacttgaggacaata

SEQ ID NO: 797 - DNA, 20 bp, Artificial sequence
  Synthetic oligonucleotide
taactcaacttgaggacaat

SEQ ID NO: 798 - DNA, 20 bp, Artificial sequence
  Synthetic oligonucleotide
ataactcaacttgaggacaa

SEQ ID NO: 799 - DNA, 20 bp, Artificial sequence
  Synthetic oligonucleotide
caggaagaaaggaaccttag

SEQ ID NO: 800 - DNA, 20 bp, Artificial sequence
  Synthetic oligonucleotide
ccaggaagaaaggaacctta

SEQ ID NO: 801 - DNA, 20 bp, Artificial sequence
  Synthetic oligonucleotide
accaggaagaaaggaacctt

SEQ ID NO: 802 - DNA, 20 bp, Artificial sequence
  Synthetic oligonucleotide
agaccaggaagaaaggaacc

SEQ ID NO: 803 - DNA, 20 bp, Artificial sequence
  Synthetic oligonucleotide
tagaccaggaagaaaggaac

SEQ ID NO: 804 - DNA, 20 bp, Artificial sequence
  Synthetic oligonucleotide
atagaccaggaagaaaggaa

SEQ ID NO: 805 - DNA, 20 bp, Artificial sequence
  Synthetic oligonucleotide
tacaatgcacaggacacgcc

SEQ ID NO: 806 - DNA, 20 bp, Artificial sequence
  Synthetic oligonucleotide
ctacaatgcacaggacacgc

SEQ ID NO: 807 - DNA, 20 bp, Artificial sequence
  Synthetic oligonucleotide
gctacaatgcacaggacacg

SEQ ID NO: 808 - DNA, 20 bp, Artificial sequence
  Synthetic oligonucleotide
atgctacaatgcacaggaca

SEQ ID NO: 809 - DNA, 20 bp, Artificial sequence
  Synthetic oligonucleotide
tatgctacaatgcacaggac

SEQ ID NO: 810 - DNA, 20 bp, Artificial sequence
  Synthetic oligonucleotide
atatgctacaatgcacagga

SEQ ID NO: 811 - DNA, 20 bp, Artificial sequence
  Synthetic oligonucleotide
ctgatatttattgctgtacg

SEQ ID NO: 812 - DNA, 20 bp, Artificial sequence
  Synthetic oligonucleotide
ctctgatatttattgctgta

SEQ ID NO: 813 - DNA, 20 bp, Artificial sequence
  Synthetic oligonucleotide
tctctgatatttattgctgt

SEQ ID NO: 814 - DNA, 20 bp, Artificial sequence
  Synthetic oligonucleotide
gtctctgatatttattgctg

SEQ ID NO: 815 - DNA, 20 bp, Artificial sequence
  Synthetic oligonucleotide
ccagaagaattacccatgca

SEQ ID NO: 816 - DNA, 20 bp, Artificial sequence
  Synthetic oligonucleotide
tccagaagaattacccatgc

SEQ ID NO: 817 - DNA, 20 bp, Artificial sequence
  Synthetic oligonucleotide
ttccagaagaattacccatg

SEQ ID NO: 818 - DNA, 20 bp, Artificial sequence
  Synthetic oligonucleotide
tcttccagaagaattaccca

SEQ ID NO: 819 - DNA, 20 bp, Artificial sequence
  Synthetic oligonucleotide
atcttccagaagaattaccc

SEQ ID NO: 820 - DNA, 20 bp, Artificial sequence
  Synthetic oligonucleotide
catcttccagaagaattacc

SEQ ID NO: 821 - DNA, 20 bp, Artificial sequence
  Synthetic oligonucleotide
tttctgcagtatcctagcct

SEQ ID NO: 822 - DNA, 20 bp, Artificial sequence
  Synthetic oligonucleotide
gtttctgcagtatcctagcc

SEQ ID NO: 823 - DNA, 20 bp, Artificial sequence
  Synthetic oligonucleotide
agtttctgcagtatcctagc

SEQ ID NO: 824 - DNA, 20 bp, Artificial sequence
  Synthetic oligonucleotide
tcagtttctgcagtatccta

SEQ ID NO: 825 - DNA, 20 bp, Artificial sequence
  Synthetic oligonucleotide
ttcagtttctgcagtatcct

SEQ ID NO: 826 - DNA, 20 bp, Artificial sequence
  Synthetic oligonucleotide
tttcagtttctgcagtatcc

SEQ ID NO: 827 - DNA, 20 bp, Artificial sequence
  Synthetic oligonucleotide
gtttccattttcttgattcc

SEQ ID NO: 828 - DNA, 20 bp, Artificial sequence
  Synthetic oligonucleotide
tgtttccattttcttgattc

SEQ ID NO: 829 - DNA, 20 bp, Artificial sequence
  Synthetic oligonucleotide
gtgtttccattttcttgatt

SEQ ID NO: 830 - DNA, 20 bp, Artificial sequence
  Synthetic oligonucleotide
tggtgtttccattttcttga

SEQ ID NO: 831 - DNA, 20 bp, Artificial sequence
  Synthetic oligonucleotide
atggtgtttccattttcttg

SEQ ID NO: 832 - DNA, 20 bp, Artificial sequence
  Synthetic oligonucleotide
aatggtgtttccattttctt

SEQ ID NO: 833 - DNA, 20 bp, Artificial sequence
  Synthetic oligonucleotide
aacccatttcatccatttaa

SEQ ID NO: 834 - DNA, 20 bp, Artificial sequence
  Synthetic oligonucleotide
gaacccatttcatccattta

SEQ ID NO: 835 - DNA, 20 bp, Artificial sequence
  Synthetic oligonucleotide
ggaacccatttcatccattt

SEQ ID NO: 836 - DNA, 20 bp, Artificial sequence
  Synthetic oligonucleotide
taggaacccatttcatccat

SEQ ID NO: 837 - DNA, 20 bp, Artificial sequence
  Synthetic oligonucleotide
gtaggaacccatttcatcca

SEQ ID NO: 838 - DNA, 20 bp, Artificial sequence
  Synthetic oligonucleotide
ggtaggaacccatttcatcc

SEQ ID NO: 839 - DNA, 20 bp, Artificial sequence
  Synthetic oligonucleotide
tgagggattgcctcagtagc

SEQ ID NO: 840 - DNA, 20 bp, Artificial sequence
  Synthetic oligonucleotide
ttgagggattgcctcagtag

SEQ ID NO: 841 - DNA, 20 bp, Artificial sequence
  Synthetic oligonucleotide
tttgagggattgcctcagta

SEQ ID NO: 842 - DNA, 20 bp, Artificial sequence
  Synthetic oligonucleotide
cctttgagggattgcctcag

SEQ ID NO: 843 - DNA, 20 bp, Artificial sequence
  Synthetic oligonucleotide
tcctttgagggattgcctca

SEQ ID NO: 844 - DNA, 20 bp, Artificial sequence
  Synthetic oligonucleotide
ctcctttgagggattgcctc

SEQ ID NO: 845 - DNA, 20 bp, Artificial sequence
  Synthetic oligonucleotide
aacttaggacttgggacatt

SEQ ID NO: 846 - DNA, 20 bp, Artificial sequence
  Synthetic oligonucleotide
taacttaggacttgggacat

SEQ ID NO: 847 - DNA, 20 bp, Artificial sequence
  Synthetic oligonucleotide
ctaacttaggacttgggaca

SEQ ID NO: 848 - DNA, 20 bp, Artificial sequence
  Synthetic oligonucleotide
cactaacttaggacttggga

SEQ ID NO: 849 - DNA, 20 bp, Artificial sequence
  Synthetic oligonucleotide
tcactaacttaggacttggg

SEQ ID NO: 850 - DNA, 20 bp, Artificial sequence
  Synthetic oligonucleotide
gtcactaacttaggacttgg

SEQ ID NO: 851 - DNA, 20 bp, Artificial sequence
  Synthetic oligonucleotide
tgggctagatcaggattggt

SEQ ID NO: 852 - DNA, 20 bp, Artificial sequence
  Synthetic oligonucleotide
atgggctagatcaggattgg

SEQ ID NO: 853 - DNA, 20 bp, Artificial sequence
  Synthetic oligonucleotide
catgggctagatcaggattg

SEQ ID NO: 854 - DNA, 20 bp, Artificial sequence
  Synthetic oligonucleotide
accatgggctagatcaggat

SEQ ID NO: 855 - DNA, 20 bp, Artificial sequence
  Synthetic oligonucleotide
taccatgggctagatcagga

SEQ ID NO: 856 - DNA, 20 bp, Artificial sequence
  Synthetic oligonucleotide
ctaccatgggctagatcagg

SEQ ID NO: 857 - DNA, 20 bp, Artificial sequence
  Synthetic oligonucleotide
atgagcttagcagtcactta

SEQ ID NO: 858 - DNA, 20 bp, Artificial sequence
  Synthetic oligonucleotide
catgagcttagcagtcactt

SEQ ID NO: 859 - DNA, 20 bp, Artificial sequence
  Synthetic oligonucleotide
ccatgagcttagcagtcact

SEQ ID NO: 860 - DNA, 20 bp, Artificial sequence
  Synthetic oligonucleotide
gtctcagcaaacctgggata

SEQ ID NO: 861 - DNA, 20 bp, Artificial sequence
  Synthetic oligonucleotide
tgtctcagcaaacctgggat

SEQ ID NO: 862 - DNA, 20 bp, Artificial sequence
  Synthetic oligonucleotide
atgtctcagcaaacctggga

SEQ ID NO: 863 - DNA, 20 bp, Artificial sequence
  Synthetic oligonucleotide
gaatgtctcagcaaacctgg

SEQ ID NO: 864 - DNA, 20 bp, Artificial sequence
  Synthetic oligonucleotide
ggaatgtctcagcaaacctg

SEQ ID NO: 865 - DNA, 20 bp, Artificial sequence
  Synthetic oligonucleotide
aggaatgtctcagcaaacct

SEQ ID NO: 866 - DNA, 20 bp, Artificial sequence
  Synthetic oligonucleotide
tacagacatagctctaacct

SEQ ID NO: 867 - DNA, 20 bp, Artificial sequence
  Synthetic oligonucleotide
atacagacatagctctaacc

SEQ ID NO: 868 - DNA, 20 bp, Artificial sequence
  Synthetic oligonucleotide
gatacagacatagctctaac

SEQ ID NO: 869 - DNA, 20 bp, Artificial sequence
  Synthetic oligonucleotide
tggatacagacatagctcta

SEQ ID NO: 870 - DNA, 20 bp, Artificial sequence
  Synthetic oligonucleotide
ctggatacagacatagctct

SEQ ID NO: 871 - DNA, 20 bp, Artificial sequence
  Synthetic oligonucleotide
gctggatacagacatagctc

SEQ ID NO: 872 - DNA, 20 bp, Artificial sequence
  Synthetic oligonucleotide
acactgtttgtgagggtcaa

SEQ ID NO: 873 - DNA, 20 bp, Artificial sequence
  Synthetic oligonucleotide
aacactgtttgtgagggtca

SEQ ID NO: 874 - DNA, 20 bp, Artificial sequence
  Synthetic oligonucleotide
caacactgtttgtgagggtc

SEQ ID NO: 875 - DNA, 20 bp, Artificial sequence
  Synthetic oligonucleotide
aacaacactgtttgtgaggg

SEQ ID NO: 876 - DNA, 20 bp, Artificial sequence
  Synthetic oligonucleotide
aaacaacactgtttgtgagg

SEQ ID NO: 877 - DNA, 20 bp, Artificial sequence
  Synthetic oligonucleotide
caaacaacactgtttgtgag

SEQ ID NO: 878 - DNA, 20 bp, Artificial sequence
  Synthetic oligonucleotide
ttcaagtttaggatctgcag

SEQ ID NO: 879 - DNA, 20 bp, Artificial sequence
  Synthetic oligonucleotide
cttcaagtttaggatctgca

SEQ ID NO: 880 - DNA, 20 bp, Artificial sequence
  Synthetic oligonucleotide
gcttcaagtttaggatctgc

SEQ ID NO: 881 - DNA, 20 bp, Artificial sequence
  Synthetic oligonucleotide
gggcttcaagtttaggatct

SEQ ID NO: 882 - DNA, 20 bp, Artificial sequence
  Synthetic oligonucleotide
agggcttcaagtttaggatc

SEQ ID NO: 883 - DNA, 20 bp, Artificial sequence
  Synthetic oligonucleotide
cagggcttcaagtttaggat

SEQ ID NO: 884 - DNA, 20 bp, Artificial sequence
  Synthetic oligonucleotide
tgtggctttaattcactaat

SEQ ID NO: 885 - DNA, 20 bp, Artificial sequence
  Synthetic oligonucleotide
atgtggctttaattcactaa

SEQ ID NO: 886 - DNA, 20 bp, Artificial sequence
  Synthetic oligonucleotide
tatgtggctttaattcacta

SEQ ID NO: 887 - DNA, 20 bp, Artificial sequence
  Synthetic oligonucleotide
ggtatgtggctttaattcac

SEQ ID NO: 888 - DNA, 20 bp, Artificial sequence
  Synthetic oligonucleotide
tggtatgtggctttaattca

SEQ ID NO: 889 - DNA, 20 bp, Artificial sequence
  Synthetic oligonucleotide
gtggtatgtggctttaattc

SEQ ID NO: 890 - DNA, 20 bp, Artificial sequence
  Synthetic oligonucleotide
tctgtgttcagttgcatcac

SEQ ID NO: 891 - DNA, 20 bp, Artificial sequence
  Synthetic oligonucleotide
ttctgtgttcagttgcatca

SEQ ID NO: 892 - DNA, 20 bp, Artificial sequence
  Synthetic oligonucleotide
gttctgtgttcagttgcatc

SEQ ID NO: 893 - DNA, 20 bp, Artificial sequence
  Synthetic oligonucleotide
gtactcatgaggaggcactt

SEQ ID NO: 894 - DNA, 20 bp, Artificial sequence
  Synthetic oligonucleotide
ggtactcatgaggaggcact

SEQ ID NO: 895 - DNA, 20 bp, Artificial sequence
  Synthetic oligonucleotide
tggtactcatgaggaggcac

SEQ ID NO: 896 - DNA, 20 bp, Artificial sequence
  Synthetic oligonucleotide
attggtactcatgaggaggc

SEQ ID NO: 897 - DNA, 20 bp, Artificial sequence
  Synthetic oligonucleotide
aattggtactcatgaggagg

SEQ ID NO: 898 - DNA, 20 bp, Artificial sequence
  Synthetic oligonucleotide
caattggtactcatgaggag

SEQ ID NO: 899 - DNA, 20 bp, Artificial sequence
  Synthetic oligonucleotide
aaactctgcaactccaaccc

SEQ ID NO: 900 - DNA, 20 bp, Artificial sequence
  Synthetic oligonucleotide
gaaactctgcaactccaacc

SEQ ID NO: 901 - DNA, 20 bp, Artificial sequence
  Synthetic oligonucleotide
ggaaactctgcaactccaac

SEQ ID NO: 902 - DNA, 20 bp, Artificial sequence
  Synthetic oligonucleotide
atggaaactctgcaactcca

SEQ ID NO: 903 - DNA, 20 bp, Artificial sequence
  Synthetic oligonucleotide
catggaaactctgcaactcc

SEQ ID NO: 904 - DNA, 20 bp, Artificial sequence
  Synthetic oligonucleotide
tcatggaaactctgcaactc

SEQ ID NO: 905 - DNA, 20 bp, Artificial sequence
  Synthetic oligonucleotide
acatctggatgtgaggctcg

SEQ ID NO: 906 - DNA, 20 bp, Artificial sequence
  Synthetic oligonucleotide
cacatctggatgtgaggctc

SEQ ID NO: 907 - DNA, 20 bp, Artificial sequence
  Synthetic oligonucleotide
gtcacatctggatgtgaggc

SEQ ID NO: 908 - DNA, 20 bp, Artificial sequence
  Synthetic oligonucleotide
tgtcacatctggatgtgagg

SEQ ID NO: 909 - DNA, 20 bp, Artificial sequence
  Synthetic oligonucleotide
ctgtcacatctggatgtgag

SEQ ID NO: 910 - DNA, 20 bp, Artificial sequence
  Synthetic oligonucleotide
gtcaattatgtgctttgcct

SEQ ID NO: 911 - DNA, 20 bp, Artificial sequence
  Synthetic oligonucleotide
acattcaaaattcttccttg

SEQ ID NO: 912 - DNA, 20 bp, Artificial sequence
  Synthetic oligonucleotide
atcctgcatatattttattg

SEQ ID NO: 913 - DNA, 20 bp, Artificial sequence
  Synthetic oligonucleotide
ctgctggtgactctgcctga

SEQ ID NO: 914 - DNA, 20 bp, Artificial sequence
  Synthetic oligonucleotide
aatgctgaaggatgggcatc

SEQ ID NO: 915 - DNA, 20 bp, Artificial sequence
  Synthetic oligonucleotide
ttatccagtagtcaatatta

SEQ ID NO: 916 - DNA, 20 bp, Artificial sequence
  Synthetic oligonucleotide
tctcatgttaaagttcttaa

SEQ ID NO: 917 - DNA, 20 bp, Artificial sequence
  Synthetic oligonucleotide
tgcacttggacaactgatag

SEQ ID NO: 918 - DNA, 20 bp, Artificial sequence
  Synthetic oligonucleotide
actcaacttgaggacaataa

SEQ ID NO: 919 - DNA, 20 bp, Artificial sequence
  Synthetic oligonucleotide
gaccaggaagaaaggaacct

SEQ ID NO: 920 - DNA, 20 bp, Artificial sequence
  Synthetic oligonucleotide
tgctacaatgcacaggacac

SEQ ID NO: 921 - DNA, 20 bp, Artificial sequence
  Synthetic oligonucleotide
tctgatatttattgctgtac

SEQ ID NO: 922 - DNA, 20 bp, Artificial sequence
  Synthetic oligonucleotide
atgcttcctttaataaatgt

SEQ ID NO: 923 - DNA, 20 bp, Artificial sequence
  Synthetic oligonucleotide
aacatttagaacctaggaga

SEQ ID NO: 924 - DNA, 20 bp, Artificial sequence
  Synthetic oligonucleotide
caagcttgcaagtaggaaaa

SEQ ID NO: 925 - DNA, 20 bp, Artificial sequence
  Synthetic oligonucleotide
ccaggctgttcatgccaagg

SEQ ID NO: 926 - DNA, 20 bp, Artificial sequence
  Synthetic oligonucleotide
cctgccaagggcaagccagg

SEQ ID NO: 927 - DNA, 20 bp, Artificial sequence
  Synthetic oligonucleotide
tttcacctggtgactggaag

SEQ ID NO: 928 - DNA, 20 bp, Artificial sequence
  Synthetic oligonucleotide
attttctaccatcaaagaga

SEQ ID NO: 929 - DNA, 20 bp, Artificial sequence
  Synthetic oligonucleotide
gattaagttttctttaaaaa

SEQ ID NO: 930 - DNA, 20 bp, Artificial sequence
  Synthetic oligonucleotide
cttccagaagaattacccat

SEQ ID NO: 931 - DNA, 20 bp, Artificial sequence
  Synthetic oligonucleotide
cagtttctgcagtatcctag

SEQ ID NO: 932 - DNA, 20 bp, Artificial sequence
  Synthetic oligonucleotide
tattttgaaaatgagattca

SEQ ID NO: 933 - DNA, 20 bp, Artificial sequence
  Synthetic oligonucleotide
gtggcccgagtaaagataaa

SEQ ID NO: 934 - DNA, 20 bp, Artificial sequence
  Synthetic oligonucleotide
cctgtcaatcctcttatatg

SEQ ID NO: 935 - DNA, 20 bp, Artificial sequence
  Synthetic oligonucleotide
ggtgtttccattttcttgat

SEQ ID NO: 936 - DNA, 20 bp, Artificial sequence
  Synthetic oligonucleotide
acagggtcaaaagttcactt

SEQ ID NO: 937 - DNA, 20 bp, Artificial sequence
  Synthetic oligonucleotide
taggaaagctgagagaatcc

SEQ ID NO: 938 - DNA, 20 bp, Artificial sequence
  Synthetic oligonucleotide
agcatatgaaaaaatactca

SEQ ID NO: 939 - DNA, 20 bp, Artificial sequence
  Synthetic oligonucleotide
cttcagaaatcagcatctga

SEQ ID NO: 940 - DNA, 20 bp, Artificial sequence
  Synthetic oligonucleotide
ttacaagtgacagtgtttgt

SEQ ID NO: 941 - DNA, 20 bp, Artificial sequence
  Synthetic oligonucleotide
atcagaccctgaagaattta

SEQ ID NO: 942 - DNA, 20 bp, Artificial sequence
  Synthetic oligonucleotide
aggaacccatttcatccatt

SEQ ID NO: 943 - DNA, 20 bp, Artificial sequence
  Synthetic oligonucleotide
cacattggtaacttaaagtt

SEQ ID NO: 944 - DNA, 20 bp, Artificial sequence
  Synthetic oligonucleotide
tattatctgactcatttctg

SEQ ID NO: 945 - DNA, 20 bp, Artificial sequence
  Synthetic oligonucleotide
aaataagacaaagaaaattc

SEQ ID NO: 946 - DNA, 20 bp, Artificial sequence
  Synthetic oligonucleotide
ttttaaaaataaccaattca

SEQ ID NO: 947 - DNA, 20 bp, Artificial sequence
  Synthetic oligonucleotide
ctttgagggattgcctcagt

SEQ ID NO: 948 - DNA, 20 bp, Artificial sequence
  Synthetic oligonucleotide
acagtcctcatgaacagatt

SEQ ID NO: 949 - DNA, 20 bp, Artificial sequence
  Synthetic oligonucleotide
actatcattaataatattgt

SEQ ID NO: 950 - DNA, 20 bp, Artificial sequence
  Synthetic oligonucleotide
atctagatttgccttataag

SEQ ID NO: 951 - DNA, 20 bp, Artificial sequence
  Synthetic oligonucleotide
tggttgaggaagacagtctc

SEQ ID NO: 952 - DNA, 20 bp, Artificial sequence
  Synthetic oligonucleotide
tggctcataacttccttagc

SEQ ID NO: 953 - DNA, 20 bp, Artificial sequence
  Synthetic oligonucleotide
actaacttaggacttgggac

SEQ ID NO: 954 - DNA, 20 bp, Artificial sequence
  Synthetic oligonucleotide
cttatagcattactaagtgg

SEQ ID NO: 955 - DNA, 20 bp, Artificial sequence
  Synthetic oligonucleotide
tggtggcaggagagagggaa

SEQ ID NO: 956 - DNA, 20 bp, Artificial sequence
  Synthetic oligonucleotide
tttgccaggaaatcttgaaa

SEQ ID NO: 957 - DNA, 20 bp, Artificial sequence
  Synthetic oligonucleotide
ataacttttctctgaaattt

SEQ ID NO: 958 - DNA, 20 bp, Artificial sequence
  Synthetic oligonucleotide
ccatgggctagatcaggatt

SEQ ID NO: 959 - DNA, 20 bp, Artificial sequence
  Synthetic oligonucleotide
tgagcttagcagtcacttag

SEQ ID NO: 960 - DNA, 20 bp, Artificial sequence
  Synthetic oligonucleotide
aatgtctcagcaaacctggg

SEQ ID NO: 961 - DNA, 20 bp, Artificial sequence
  Synthetic oligonucleotide
ggatacagacatagctctaa

SEQ ID NO: 962 - DNA, 20 bp, Artificial sequence
  Synthetic oligonucleotide
acaacactgtttgtgagggt

SEQ ID NO: 963 - DNA, 20 bp, Artificial sequence
  Synthetic oligonucleotide
tctattttctaatagctgtt

SEQ ID NO: 964 - DNA, 20 bp, Artificial sequence
  Synthetic oligonucleotide
ggccccacctctgaccttca

SEQ ID NO: 965 - DNA, 20 bp, Artificial sequence
  Synthetic oligonucleotide
tggtaaagctagaaaaaaaa

SEQ ID NO: 966 - DNA, 20 bp, Artificial sequence
  Synthetic oligonucleotide
aagtggtaaatatgatcaca

SEQ ID NO: 967 - DNA, 20 bp, Artificial sequence
  Synthetic oligonucleotide
ggcttcaagtttaggatctg

SEQ ID NO: 968 - DNA, 20 bp, Artificial sequence
  Synthetic oligonucleotide
ttgttgacactctcttttgg

SEQ ID NO: 969 - DNA, 20 bp, Artificial sequence
  Synthetic oligonucleotide
gtatgtggctttaattcact

SEQ ID NO: 970 - DNA, 20 bp, Artificial sequence
  Synthetic oligonucleotide
aattagttgttttggcaaat

SEQ ID NO: 971 - DNA, 20 bp, Artificial sequence
  Synthetic oligonucleotide
ctgtgttcagttgcatcacg

SEQ ID NO: 972 - DNA, 20 bp, Artificial sequence
  Synthetic oligonucleotide
aatgtggaagtttcctaaca

SEQ ID NO: 973 - DNA, 20 bp, Artificial sequence
  Synthetic oligonucleotide
ttggtactcatgaggaggca

SEQ ID NO: 974 - DNA, 20 bp, Artificial sequence
  Synthetic oligonucleotide
tttctctgtgtttaaaattg

SEQ ID NO: 975 - DNA, 20 bp, Artificial sequence
  Synthetic oligonucleotide
gtaaagcacaatgaacaaaa

SEQ ID NO: 976 - DNA, 20 bp, Artificial sequence
  Synthetic oligonucleotide
atcacagatctttgctacaa

SEQ ID NO: 977 - DNA, 20 bp, Artificial sequence
  Synthetic oligonucleotide
tcctgcctttctgaaccaaa

SEQ ID NO: 978 - DNA, 20 bp, Artificial sequence
  Synthetic oligonucleotide
tggaaactctgcaactccaa

SEQ ID NO: 979 - DNA, 20 bp, Artificial sequence
  Synthetic oligonucleotide
acacagtagggaacaatttt

SEQ ID NO: 980 - DNA, 20 bp, Artificial sequence
  Synthetic oligonucleotide
agacagatggtgaaatgatg

SEQ ID NO: 981 - DNA, 20 bp, Artificial sequence
  Synthetic oligonucleotide
aaacagaaagagaagaaaac

SEQ ID NO: 982 - DNA, 20 bp, Artificial sequence
  Synthetic oligonucleotide
cttagataaatacttcaaga

SEQ ID NO: 983 - DNA, 20 bp, Artificial sequence
  Synthetic oligonucleotide
agccacttcttttacaacct

SEQ ID NO: 984 - DNA, 20 bp, Artificial sequence
  Synthetic oligonucleotide
tcacatctggatgtgaggct

SEQ ID NO: 985 - DNA, 20 bp, Artificial sequence
  Synthetic oligonucleotide
gactgaaacttaaaggtggg

SEQ ID NO: 986 - DNA, 20 bp, Artificial sequence
  Synthetic oligonucleotide
aaagatgtgcaatcatctaa

SEQ ID NO: 987 - DNA, 17 bp, Artificial sequence
  Synthetic oligonucleotide
gctggtgactctgcctg

SEQ ID NO: 988 - DNA, 17 bp, Artificial sequence
  Synthetic oligonucleotide
tgctggtgactctgcct

SEQ ID NO: 989 - DNA, 17 bp, Artificial sequence
  Synthetic oligonucleotide
ctgctggtgactctgcc

SEQ ID NO: 990 - DNA, 17 bp, Artificial sequence
  Synthetic oligonucleotide
agtagtcaatattattt

SEQ ID NO: 991 - DNA, 17 bp, Artificial sequence
  Synthetic oligonucleotide
cagtagtcaatattatt

SEQ ID NO: 992 - DNA, 17 bp, Artificial sequence
  Synthetic oligonucleotide
ccagtagtcaatattat

SEQ ID NO: 993 - DNA, 17 bp, Artificial sequence
  Synthetic oligonucleotide
cctttgggtgaatagca

SEQ ID NO: 994 - DNA, 17 bp, Artificial sequence
  Synthetic oligonucleotide
acctttgggtgaatagc

SEQ ID NO: 995 - DNA, 17 bp, Artificial sequence
  Synthetic oligonucleotide
cacctttgggtgaatag

SEQ ID NO: 996 - DNA, 17 bp, Artificial sequence
  Synthetic oligonucleotide
caacttgaggacaataa

SEQ ID NO: 997 - DNA, 17 bp, Artificial sequence
  Synthetic oligonucleotide
tcaacttgaggacaata

SEQ ID NO: 998 - DNA, 17 bp, Artificial sequence
  Synthetic oligonucleotide
ctcaacttgaggacaat

SEQ ID NO: 999 - DNA, 17 bp, Artificial sequence
  Synthetic oligonucleotide
caggaagaaaggaacct

SEQ ID NO: 1000 - DNA, 17 bp, Artificial sequence
  Synthetic oligonucleotide
ccaggaagaaaggaacc

SEQ ID NO: 1001 - DNA, 17 bp, Artificial sequence
  Synthetic oligonucleotide
accaggaagaaaggaac

SEQ ID NO: 1002 - DNA, 17 bp, Artificial sequence
  Synthetic oligonucleotide
tgcagtcatgtacacaa

SEQ ID NO: 1003 - DNA, 17 bp, Artificial sequence
  Synthetic oligonucleotide
ctgcagtcatgtacaca

SEQ ID NO: 1004 - DNA, 17 bp, Artificial sequence
  Synthetic oligonucleotide
tctgcagtcatgtacac

SEQ ID NO: 1005 - DNA, 17 bp, Artificial sequence
  Synthetic oligonucleotide
tggtttgtcaatccttt

SEQ ID NO: 1006 - DNA, 17 bp, Artificial sequence
  Synthetic oligonucleotide
ttggtttgtcaatcctt

SEQ ID NO: 1007 - DNA, 17 bp, Artificial sequence
  Synthetic oligonucleotide
cttggtttgtcaatcct

SEQ ID NO: 1008 - DNA, 17 bp, Artificial sequence
  Synthetic oligonucleotide
tacaatgcacaggacac

SEQ ID NO: 1009 - DNA, 17 bp, Artificial sequence
  Synthetic oligonucleotide
ctacaatgcacaggaca

SEQ ID NO: 1010 - DNA, 17 bp, Artificial sequence
  Synthetic oligonucleotide
gctacaatgcacaggac

SEQ ID NO: 1011 - DNA, 17 bp, Artificial sequence
  Synthetic oligonucleotide
gatatttattgctgtac

SEQ ID NO: 1012 - DNA, 17 bp, Artificial sequence
  Synthetic oligonucleotide
tgatatttattgctgta

SEQ ID NO: 1013 - DNA, 17 bp, Artificial sequence
  Synthetic oligonucleotide
ctgatatttattgctgt

SEQ ID NO: 1014 - DNA, 17 bp, Artificial sequence
  Synthetic oligonucleotide
agggtctttacaaagtt

SEQ ID NO: 1015 - DNA, 17 bp, Artificial sequence
  Synthetic oligonucleotide
cagggtctttacaaagt

SEQ ID NO: 1016 - DNA, 17 bp, Artificial sequence
  Synthetic oligonucleotide
ccagggtctttacaaag

SEQ ID NO: 1017 - DNA, 17 bp, Artificial sequence
  Synthetic oligonucleotide
ttctgcagtatcctagc

SEQ ID NO: 1018 - DNA, 17 bp, Artificial sequence
  Synthetic oligonucleotide
tttctgcagtatcctag

SEQ ID NO: 1019 - DNA, 17 bp, Artificial sequence
  Synthetic oligonucleotide
gtttctgcagtatccta

SEQ ID NO: 1020 - DNA, 17 bp, Artificial sequence
  Synthetic oligonucleotide
agtttctgcagtatcct

SEQ ID NO: 1021 - DNA, 17 bp, Artificial sequence
  Synthetic oligonucleotide
cagtttctgcagtatcc

SEQ ID NO: 1022 - DNA, 17 bp, Artificial sequence
  Synthetic oligonucleotide
caaattccagtcctagg

SEQ ID NO: 1023 - DNA, 17 bp, Artificial sequence
  Synthetic oligonucleotide
ccaaattccagtcctag

SEQ ID NO: 1024 - DNA, 17 bp, Artificial sequence
  Synthetic oligonucleotide
tccaaattccagtccta

SEQ ID NO: 1025 - DNA, 17 bp, Artificial sequence
  Synthetic oligonucleotide
aacccatttcatccatt

SEQ ID NO: 1026 - DNA, 17 bp, Artificial sequence
  Synthetic oligonucleotide
gaacccatttcatccat

SEQ ID NO: 1027 - DNA, 17 bp, Artificial sequence
  Synthetic oligonucleotide
ggaacccatttcatcca

SEQ ID NO: 1028 - DNA, 17 bp, Artificial sequence
  Synthetic oligonucleotide
gcttcatgtctttctag

SEQ ID NO: 1029 - DNA, 17 bp, Artificial sequence
  Synthetic oligonucleotide
tgcttcatgtctttcta

SEQ ID NO: 1030 - DNA, 17 bp, Artificial sequence
  Synthetic oligonucleotide
gtgcttcatgtctttct

SEQ ID NO: 1031 - DNA, 17 bp, Artificial sequence
  Synthetic oligonucleotide
tgagcttagcagtcact

SEQ ID NO: 1032 - DNA, 17 bp, Artificial sequence
  Synthetic oligonucleotide
catgagcttagcagtca

SEQ ID NO: 1033 - DNA, 17 bp, Artificial sequence
  Synthetic oligonucleotide
tacagacatagctctaa

SEQ ID NO: 1034 - DNA, 17 bp, Artificial sequence
  Synthetic oligonucleotide
atacagacatagctcta

SEQ ID NO: 1035 - DNA, 17 bp, Artificial sequence
  Synthetic oligonucleotide
gatacagacatagctct

SEQ ID NO: 1036 - DNA, 17 bp, Artificial sequence
  Synthetic oligonucleotide
tgtggctttaattcact

SEQ ID NO: 1037 - DNA, 17 bp, Artificial sequence
  Synthetic oligonucleotide
atgtggctttaattcac

SEQ ID NO: 1038 - DNA, 17 bp, Artificial sequence
  Synthetic oligonucleotide
tatgtggctttaattca

SEQ ID NO: 1039 - DNA, 17 bp, Artificial sequence
  Synthetic oligonucleotide
tgttcagttgcatcacg

SEQ ID NO: 1040 - DNA, 17 bp, Artificial sequence
  Synthetic oligonucleotide
gtgttcagttgcatcac

SEQ ID NO: 1041 - DNA, 17 bp, Artificial sequence
  Synthetic oligonucleotide
tgtgttcagttgcatca

SEQ ID NO: 1042 - DNA, 17 bp, Artificial sequence
  Synthetic oligonucleotide
catctggatgtgaggct

SEQ ID NO: 1043 - DNA, 17 bp, Artificial sequence
  Synthetic oligonucleotide
acatctggatgtgaggc

SEQ ID NO: 1044 - DNA, 17 bp, Artificial sequence
  Synthetic oligonucleotide
cacatctggatgtgagg

SEQ ID NO: 1045 - DNA, 17 bp, Artificial sequence
  Synthetic oligonucleotide
tcaggtaatttctggaa

SEQ ID NO: 1046 - DNA, 17 bp, Artificial sequence
  Synthetic oligonucleotide
ctcaggtaatttctgga

SEQ ID NO: 1047 - DNA, 17 bp, Artificial sequence
  Synthetic oligonucleotide
tctcaggtaatttctgg

SEQ ID NO: 1048 - DNA, 17 bp, Artificial sequence
  Synthetic oligonucleotide
ttgcttatttacctggg

SEQ ID NO: 1049 - DNA, 17 bp, Artificial sequence
  Synthetic oligonucleotide
tttgcttatttacctgg

SEQ ID NO: 1050 - DNA, 17 bp, Artificial sequence
  Synthetic oligonucleotide
ttttgcttatttacctg

SEQ ID NO: 1051 - DNA, 17 bp, Artificial sequence
  Synthetic oligonucleotide
atgatgttactactact

SEQ ID NO: 1052 - DNA, 17 bp, Artificial sequence
  Synthetic oligonucleotide
aatgatgttactactac

SEQ ID NO: 1053 - DNA, 17 bp, Artificial sequence
  Synthetic oligonucleotide
caatgatgttactacta

SEQ ID NO: 1054 - DNA, 17 bp, Artificial sequence
  Synthetic oligonucleotide
cccctagagcaatggtc

SEQ ID NO: 1055 - DNA, 17 bp, Artificial sequence
  Synthetic oligonucleotide
ccccctagagcaatggt

SEQ ID NO: 1056 - DNA, 17 bp, Artificial sequence
  Synthetic oligonucleotide
tccccctagagcaatgg

SEQ ID NO: 1057 - DNA, 17 bp, Artificial sequence
  Synthetic oligonucleotide
tcaattgcagatgctct

SEQ ID NO: 1058 - DNA, 17 bp, Artificial sequence
  Synthetic oligonucleotide
ctcaattgcagatgctc

SEQ ID NO: 1059 - DNA, 17 bp, Artificial sequence
  Synthetic oligonucleotide
gctcaattgcagatgct

SEQ ID NO: 1060 - DNA, 17 bp, Artificial sequence
  Synthetic oligonucleotide
agctcaattgcagatgc

SEQ ID NO: 1061 - DNA, 17 bp, Artificial sequence
  Synthetic oligonucleotide
gtatattcagtccaagg

SEQ ID NO: 1062 - DNA, 17 bp, Artificial sequence
  Synthetic oligonucleotide
agtatattcagtccaag

SEQ ID NO: 1063 - DNA, 17 bp, Artificial sequence
  Synthetic oligonucleotide
cagtatattcagtccaa

SEQ ID NO: 1064 - DNA, 20 bp, Artificial sequence
  Synthetic oligonucleotide
gagtatttcaggctggaaaa

SEQ ID NO: 1065 - DNA, 20 bp, Artificial sequence
  Synthetic oligonucleotide
gtaactcaggaatggaaaac

SEQ ID NO: 1066 - DNA, 20 bp, Artificial sequence
  Synthetic oligonucleotide
agtaactcaggaatggaaaa

SEQ ID NO: 1067 - DNA, 20 bp, Artificial sequence
  Synthetic oligonucleotide
aagtaactcaggaatggaaa

SEQ ID NO: 1068 - DNA, 20 bp, Artificial sequence
  Synthetic oligonucleotide
gagatttcaaataaatctca

SEQ ID NO: 1069 - DNA, 20 bp, Artificial sequence
  Synthetic oligonucleotide
tgagatttcaaataaatctc

SEQ ID NO: 1070 - DNA, 20 bp, Artificial sequence
  Synthetic oligonucleotide
gtgagatttcaaataaatct

SEQ ID NO: 1071 - DNA, 20 bp, Artificial sequence
  Synthetic oligonucleotide
tgtgagatttcaaataaatc

SEQ ID NO: 1072 - DNA, 20 bp, Artificial sequence
  Synthetic oligonucleotide
ttgtgagatttcaaataaat

SEQ ID NO: 1073 - DNA, 20 bp, Artificial sequence
  Synthetic oligonucleotide
tttgtgagatttcaaataaa

SEQ ID NO: 1074 - DNA, 20 bp, Artificial sequence
  Synthetic oligonucleotide
ctttgtgagatttcaaataa

SEQ ID NO: 1075 - DNA, 20 bp, Artificial sequence
  Synthetic oligonucleotide
actttgtgagatttcaaata

SEQ ID NO: 1076 - DNA, 20 bp, Artificial sequence
  Synthetic oligonucleotide
cactttgtgagatttcaaat

SEQ ID NO: 1077 - DNA, 20 bp, Artificial sequence
  Synthetic oligonucleotide
agtatttcaggctggaaaaa

SEQ ID NO: 1078 - DNA, 20 bp, Artificial sequence
  Synthetic oligonucleotide
tgagtatttcaggctggaaa

SEQ ID NO: 1079 - DNA, 20 bp, Artificial sequence
  Synthetic oligonucleotide
tctgagtatttcaggctgga

SEQ ID NO: 1080 - DNA, 20 bp, Artificial sequence
  Synthetic oligonucleotide
atctgagtatttcaggctgg

SEQ ID NO: 1081 - DNA, 20 bp, Artificial sequence
  Synthetic oligonucleotide
tatctgagtatttcaggctg

SEQ ID NO: 1082 - DNA, 20 bp, Artificial sequence
  Synthetic oligonucleotide
ttttgtgttatgccttgagg

SEQ ID NO: 1083 - DNA, 20 bp, Artificial sequence
  Synthetic oligonucleotide
tttttgtgttatgccttgag

SEQ ID NO: 1084 - DNA, 20 bp, Artificial sequence
  Synthetic oligonucleotide
atttttgtgttatgccttga

SEQ ID NO: 1085 - DNA, 20 bp, Artificial sequence
  Synthetic oligonucleotide
atatttttgtgttatgcctt

SEQ ID NO: 1086 - DNA, 20 bp, Artificial sequence
  Synthetic oligonucleotide
aatatttttgtgttatgcct

SEQ ID NO: 1087 - DNA, 20 bp, Artificial sequence
  Synthetic oligonucleotide
aaatatttttgtgttatgcc

SEQ ID NO: 1088 - DNA, 20 bp, Artificial sequence
  Synthetic oligonucleotide
ttgcttatttacctgggtaa

SEQ ID NO: 1089 - DNA, 20 bp, Artificial sequence
  Synthetic oligonucleotide
tttgcttatttacctgggta

SEQ ID NO: 1090 - DNA, 20 bp, Artificial sequence
  Synthetic oligonucleotide
ttttgcttatttacctgggt

SEQ ID NO: 1091 - DNA, 20 bp, Artificial sequence
  Synthetic oligonucleotide
ccttttgcttatttacctgg

SEQ ID NO: 1092 - DNA, 20 bp, Artificial sequence
  Synthetic oligonucleotide
gccttttgcttatttacctg

SEQ ID NO: 1093 - DNA, 20 bp, Artificial sequence
  Synthetic oligonucleotide
tgccttttgcttatttacct

SEQ ID NO: 1094 - DNA, 20 bp, Artificial sequence
  Synthetic oligonucleotide
atgatgttactactactcaa

SEQ ID NO: 1095 - DNA, 20 bp, Artificial sequence
  Synthetic oligonucleotide
aatgatgttactactactca

SEQ ID NO: 1096 - DNA, 20 bp, Artificial sequence
  Synthetic oligonucleotide
caatgatgttactactactc

SEQ ID NO: 1097 - DNA, 20 bp, Artificial sequence
  Synthetic oligonucleotide
tccaatgatgttactactac

SEQ ID NO: 1098 - DNA, 20 bp, Artificial sequence
  Synthetic oligonucleotide
ttccaatgatgttactacta

SEQ ID NO: 1099 - DNA, 20 bp, Artificial sequence
  Synthetic oligonucleotide
attccaatgatgttactact

SEQ ID NO: 1100 - DNA, 20 bp, Artificial sequence
  Synthetic oligonucleotide
cccctagagcaatggtctag

SEQ ID NO: 1101 - DNA, 20 bp, Artificial sequence
  Synthetic oligonucleotide
ccccctagagcaatggtcta

SEQ ID NO: 1102 - DNA, 20 bp, Artificial sequence
  Synthetic oligonucleotide
tccccctagagcaatggtct

SEQ ID NO: 1103 - DNA, 20 bp, Artificial sequence
  Synthetic oligonucleotide
tatccccctagagcaatggt

SEQ ID NO: 1104 - DNA, 20 bp, Artificial sequence
  Synthetic oligonucleotide
atatccccctagagcaatgg

SEQ ID NO: 1105 - DNA, 20 bp, Artificial sequence
  Synthetic oligonucleotide
aatatccccctagagcaatg

SEQ ID NO: 1106 - DNA, 20 bp, Artificial sequence
  Synthetic oligonucleotide
gctcacatttggaagacagt

SEQ ID NO: 1107 - DNA, 20 bp, Artificial sequence
  Synthetic oligonucleotide
ggctcacatttggaagacag

SEQ ID NO: 1108 - DNA, 20 bp, Artificial sequence
  Synthetic oligonucleotide
aggctcacatttggaagaca

SEQ ID NO: 1109 - DNA, 20 bp, Artificial sequence
  Synthetic oligonucleotide
agaggctcacatttggaaga

SEQ ID NO: 1110 - DNA, 20 bp, Artificial sequence
  Synthetic oligonucleotide
tagaggctcacatttggaag

SEQ ID NO: 1111 - DNA, 20 bp, Artificial sequence
  Synthetic oligonucleotide
ttagaggctcacatttggaa

SEQ ID NO: 1112 - DNA, 20 bp, Artificial sequence
  Synthetic oligonucleotide
ctcaattgcagatgctctga

SEQ ID NO: 1113 - DNA, 20 bp, Artificial sequence
  Synthetic oligonucleotide
gctcaattgcagatgctctg

SEQ ID NO: 1114 - DNA, 20 bp, Artificial sequence
  Synthetic oligonucleotide
agctcaattgcagatgctct

SEQ ID NO: 1115 - DNA, 20 bp, Artificial sequence
  Synthetic oligonucleotide
aaagctcaattgcagatgct

SEQ ID NO: 1116 - DNA, 20 bp, Artificial sequence
  Synthetic oligonucleotide
taaagctcaattgcagatgc

SEQ ID NO: 1117 - DNA, 20 bp, Artificial sequence
  Synthetic oligonucleotide
ataaagctcaattgcagatg

SEQ ID NO: 1118 - DNA, 20 bp, Artificial sequence
  Synthetic oligonucleotide
gtgagtccattaaacctctt

SEQ ID NO: 1119 - DNA, 20 bp, Artificial sequence
  Synthetic oligonucleotide
tgtgagtccattaaacctct

SEQ ID NO: 1120 - DNA, 20 bp, Artificial sequence
  Synthetic oligonucleotide
actgtgagtccattaaacct

SEQ ID NO: 1121 - DNA, 20 bp, Artificial sequence
  Synthetic oligonucleotide
aactgtgagtccattaaacc

SEQ ID NO: 1122 - DNA, 20 bp, Artificial sequence
  Synthetic oligonucleotide
gaactgtgagtccattaaac

SEQ ID NO: 1123 - DNA, 20 bp, Artificial sequence
  Synthetic oligonucleotide
atattgaaaggcccatcaaa

SEQ ID NO: 1124 - DNA, 20 bp, Artificial sequence
  Synthetic oligonucleotide
aatattgaaaggcccatcaa

SEQ ID NO: 1125 - DNA, 20 bp, Artificial sequence
  Synthetic oligonucleotide
aaatattgaaaggcccatca

SEQ ID NO: 1126 - DNA, 20 bp, Artificial sequence
  Synthetic oligonucleotide
gaaaatattgaaaggcccat

SEQ ID NO: 1127 - DNA, 20 bp, Artificial sequence
  Synthetic oligonucleotide
ggaaaatattgaaaggccca

SEQ ID NO: 1128 - DNA, 20 bp, Artificial sequence
  Synthetic oligonucleotide
aggaaaatattgaaaggccc

SEQ ID NO: 1129 - DNA, 20 bp, Artificial sequence
  Synthetic oligonucleotide
gtatattcagtccaaggatc

SEQ ID NO: 1130 - DNA, 20 bp, Artificial sequence
  Synthetic oligonucleotide
agtatattcagtccaaggat

SEQ ID NO: 1131 - DNA, 20 bp, Artificial sequence
  Synthetic oligonucleotide
cagtatattcagtccaagga

SEQ ID NO: 1132 - DNA, 20 bp, Artificial sequence
  Synthetic oligonucleotide
aacagtatattcagtccaag

SEQ ID NO: 1133 - DNA, 20 bp, Artificial sequence
  Synthetic oligonucleotide
aaacagtatattcagtccaa

SEQ ID NO: 1134 - DNA, 20 bp, Artificial sequence
  Synthetic oligonucleotide
aaaacagtatattcagtcca

SEQ ID NO: 1135 - DNA, 20 bp, Artificial sequence
  Synthetic oligonucleotide
tctattgttgccacctttat

SEQ ID NO: 1136 - DNA, 20 bp, Artificial sequence
  Synthetic oligonucleotide
ttctattgttgccaccttta

SEQ ID NO: 1137 - DNA, 20 bp, Artificial sequence
  Synthetic oligonucleotide
tttctattgttgccaccttt

SEQ ID NO: 1138 - DNA, 20 bp, Artificial sequence
  Synthetic oligonucleotide
agtttctattgttgccacct

SEQ ID NO: 1139 - DNA, 20 bp, Artificial sequence
  Synthetic oligonucleotide
cagtttctattgttgccacc

SEQ ID NO: 1140 - DNA, 20 bp, Artificial sequence
  Synthetic oligonucleotide
ccagtttctattgttgccac

SEQ ID NO: 1141 - DNA, 20 bp, Artificial sequence
  Synthetic oligonucleotide
gcagaactgattgcttactt

SEQ ID NO: 1142 - DNA, 20 bp, Artificial sequence
  Synthetic oligonucleotide
aggtcataagattttcattt

SEQ ID NO: 1143 - DNA, 20 bp, Artificial sequence
  Synthetic oligonucleotide
gcctctggccataaagaaat

SEQ ID NO: 1144 - DNA, 20 bp, Artificial sequence
  Synthetic oligonucleotide
aaagtttaagaggcacccca

SEQ ID NO: 1145 - DNA, 20 bp, Artificial sequence
  Synthetic oligonucleotide
gaataagcacaaaagtttaa

SEQ ID NO: 1146 - DNA, 20 bp, Artificial sequence
  Synthetic oligonucleotide
gaaccaaataaacctctctt

SEQ ID NO: 1147 - DNA, 20 bp, Artificial sequence
  Synthetic oligonucleotide
atgttgaaatttgatcccca

SEQ ID NO: 1148 - DNA, 20 bp, Artificial sequence
  Synthetic oligonucleotide
tgtgagagctcactcactat

SEQ ID NO: 1149 - DNA, 20 bp, Artificial sequence
  Synthetic oligonucleotide
cttgtgagagctcactcact

SEQ ID NO: 1150 - DNA, 20 bp, Artificial sequence
  Synthetic oligonucleotide
acatggtggcaggagagagg

SEQ ID NO: 1151 - DNA, 20 bp, Artificial sequence
  Synthetic oligonucleotide
ctagaaagaaactacctgag

SEQ ID NO: 1152 - DNA, 20 bp, Artificial sequence
  Synthetic oligonucleotide
aacttcagttgtaaaataat

SEQ ID NO: 1153 - DNA, 20 bp, Artificial sequence
  Synthetic oligonucleotide
gaaaaggattttgagatttc

SEQ ID NO: 1154 - DNA, 20 bp, Artificial sequence
  Synthetic oligonucleotide
cttagctgtcaaggcccttt

SEQ ID NO: 1155 - DNA, 20 bp, Artificial sequence
  Synthetic oligonucleotide
tgtgcttcatgtctttctag

SEQ ID NO: 1156 - DNA, 20 bp, Artificial sequence
  Synthetic oligonucleotide
cccttgaacatgctatcctt

SEQ ID NO: 1157 - DNA, 20 bp, Artificial sequence
  Synthetic oligonucleotide
cttgcagggatgcatctcag

SEQ ID NO: 1158 - DNA, 20 bp, Artificial sequence
  Synthetic oligonucleotide
tctcttgcacatctaatttc

SEQ ID NO: 1159 - DNA, 20 bp, Artificial sequence
  Synthetic oligonucleotide
cttccagcacaacccatcac

SEQ ID NO: 1160 - DNA, 20 bp, Artificial sequence
  Synthetic oligonucleotide
gtaactacattccctttatc

SEQ ID NO: 1161 - DNA, 20 bp, Artificial sequence
  Synthetic oligonucleotide
agtaactacattccctttat

SEQ ID NO: 1162 - DNA, 20 bp, Artificial sequence
  Synthetic oligonucleotide
cagatagcacagggctaaaa

SEQ ID NO: 1163 - DNA, 20 bp, Artificial sequence
  Synthetic oligonucleotide
agaatcaggaatgtttgcct

SEQ ID NO: 1164 - DNA, 20 bp, Artificial sequence
  Synthetic oligonucleotide
tgactcaatcatttagactt

SEQ ID NO: 1165 - DNA, 20 bp, Artificial sequence
  Synthetic oligonucleotide
tcaacagtcaatggacttgt

SEQ ID NO: 1166 - DNA, 20 bp, Artificial sequence
  Synthetic oligonucleotide
aatttctactgctatgatgc

SEQ ID NO: 1167 - DNA, 20 bp, Artificial sequence
  Synthetic oligonucleotide
atggttccaaatttctatct

SEQ ID NO: 1168 - DNA, 20 bp, Artificial sequence
  Synthetic oligonucleotide
ctgtatggctttaagtattc

SEQ ID NO: 1169 - DNA, 20 bp, Artificial sequence
  Synthetic oligonucleotide
aacttatgaactgttcacca

SEQ ID NO: 1170 - DNA, 20 bp, Artificial sequence
  Synthetic oligonucleotide
aataagcttgaagtctgaag

SEQ ID NO: 1171 - DNA, 20 bp, Artificial sequence
  Synthetic oligonucleotide
tagttatctaactgcccaat

SEQ ID NO: 1172 - DNA, 20 bp, Artificial sequence
  Synthetic oligonucleotide
ttctgcaaagcttcccagta

SEQ ID NO: 1173 - DNA, 20 bp, Artificial sequence
  Synthetic oligonucleotide
acaacttcaagcttcacata

SEQ ID NO: 1174 - DNA, 20 bp, Artificial sequence
  Synthetic oligonucleotide
gaatcaatgttctggcaaga

SEQ ID NO: 1175 - DNA, 20 bp, Artificial sequence
  Synthetic oligonucleotide
cagcctttcagctgtgaaag

SEQ ID NO: 1176 - DNA, 20 bp, Artificial sequence
  Synthetic oligonucleotide
aacaatgccaagaaatctat

SEQ ID NO: 1177 - DNA, 20 bp, Artificial sequence
  Synthetic oligonucleotide
cccacagtaacaatgccaag

SEQ ID NO: 1178 - DNA, 20 bp, Artificial sequence
  Synthetic oligonucleotide
ttttacctcccagtgaaact

SEQ ID NO: 1179 - DNA, 20 bp, Artificial sequence
  Synthetic oligonucleotide
taattgttgatccatgatgt

SEQ ID NO: 1180 - DNA, 20 bp, Artificial sequence
  Synthetic oligonucleotide
gttggagagacaagtttaac

SEQ ID NO: 1181 - DNA, 20 bp, Artificial sequence
  Synthetic oligonucleotide
agtcataaaattcaaattat

SEQ ID NO: 1182 - DNA, 20 bp, Artificial sequence
  Synthetic oligonucleotide
ggccttgggcacactttctc

SEQ ID NO: 1183 - DNA, 20 bp, Artificial sequence
  Synthetic oligonucleotide
aagtttttattgaagttaat

SEQ ID NO: 1184 - DNA, 20 bp, Artificial sequence
  Synthetic oligonucleotide
aagaaaaattaggaagctag

SEQ ID NO: 1185 - DNA, 20 bp, Artificial sequence
  Synthetic oligonucleotide
cagggagataagtttattca

SEQ ID NO: 1186 - DNA, 20 bp, Artificial sequence
  Synthetic oligonucleotide
atttaatacacattggaata

SEQ ID NO: 1187 - DNA, 20 bp, Artificial sequence
  Synthetic oligonucleotide
gtaggactatttatgattcc

SEQ ID NO: 1188 - DNA, 20 bp, Artificial sequence
  Synthetic oligonucleotide
cactctcttgggctgttaag

SEQ ID NO: 1189 - DNA, 20 bp, Artificial sequence
  Synthetic oligonucleotide
ttgtttgagttccaaaagaa

SEQ ID NO: 1190 - DNA, 20 bp, Artificial sequence
  Synthetic oligonucleotide
tttgccatgagacacacaat

SEQ ID NO: 1191 - DNA, 20 bp, Artificial sequence
  Synthetic oligonucleotide
caccaaacctcagagacatg

SEQ ID NO: 1192 - DNA, 20 bp, Artificial sequence
  Synthetic oligonucleotide
ccactgttaagtgatgcatg

SEQ ID NO: 1193 - DNA, 20 bp, Artificial sequence
  Synthetic oligonucleotide
ctctcaggtaatttctggaa

SEQ ID NO: 1194 - DNA, 20 bp, Artificial sequence
  Synthetic oligonucleotide
gctcctcacaatgacccttt

SEQ ID NO: 1195 - DNA, 20 bp, Artificial sequence
  Synthetic oligonucleotide
gggactggcactggtaattt

SEQ ID NO: 1196 - DNA, 20 bp, Artificial sequence
  Synthetic oligonucleotide
ctaaccattagttactgtat

SEQ ID NO: 1197 - DNA, 20 bp, Artificial sequence
  Synthetic oligonucleotide
ggattttaggttcttgctgt

SEQ ID NO: 1198 - DNA, 20 bp, Artificial sequence
  Synthetic oligonucleotide
tgaatcatatactgatatca

SEQ ID NO: 1199 - DNA, 20 bp, Artificial sequence
  Synthetic oligonucleotide
ttgaggtattaaattttaaa

SEQ ID NO: 1200 - DNA, 20 bp, Artificial sequence
  Synthetic oligonucleotide
agtttgtaatgtagtgattt

SEQ ID NO: 1201 - DNA, 20 bp, Artificial sequence
  Synthetic oligonucleotide
aaatatttgatagctcacat

SEQ ID NO: 1202 - DNA, 20 bp, Artificial sequence
  Synthetic oligonucleotide
agaaatatttgatagctcac

SEQ ID NO: 1203 - DNA, 20 bp, Artificial sequence
  Synthetic oligonucleotide
ccacatttcaaatgttctct

SEQ ID NO: 1204 - DNA, 20 bp, Artificial sequence
  Synthetic oligonucleotide
gcaggaagagtggcatggac

SEQ ID NO: 1205 - DNA, 20 bp, Artificial sequence
  Synthetic oligonucleotide
cacttatccaaatgcagaga

SEQ ID NO: 1206 - DNA, 20 bp, Artificial sequence
  Synthetic oligonucleotide
caaggtaatgggaggctagc

SEQ ID NO: 1207 - DNA, 20 bp, Artificial sequence
  Synthetic oligonucleotide
atagtcaaagctaaggatat

SEQ ID NO: 1208 - DNA, 20 bp, Artificial sequence
  Synthetic oligonucleotide
gtaatttcattcatgcttcc

SEQ ID NO: 1209 - DNA, 20 bp, Artificial sequence
  Synthetic oligonucleotide
gtccacattcagctgtgtgt

SEQ ID NO: 1210 - DNA, 20 bp, Artificial sequence
  Synthetic oligonucleotide
tcattcaggaaattctgcta

SEQ ID NO: 1211 - DNA, 20 bp, Artificial sequence
  Synthetic oligonucleotide
aacatgtctcattcaggaaa

SEQ ID NO: 1212 - DNA, 20 bp, Artificial sequence
  Synthetic oligonucleotide
taacatgtctcattcaggaa

SEQ ID NO: 1213 - DNA, 20 bp, Artificial sequence
  Synthetic oligonucleotide
agattcctcaaattcagtga

SEQ ID NO: 1214 - DNA, 20 bp, Artificial sequence
  Synthetic oligonucleotide
taagcggaaaaggagaaaag

SEQ ID NO: 1215 - DNA, 20 bp, Artificial sequence
  Synthetic oligonucleotide
aaagcaagagaattcctaaa

SEQ ID NO: 1216 - DNA, 20 bp, Artificial sequence
  Synthetic oligonucleotide
aatgaacctttaacttagta

SEQ ID NO: 1217 - DNA, 20 bp, Artificial sequence
  Synthetic oligonucleotide
aaagctttgtggataaagtt

SEQ ID NO: 1218 - DNA, 20 bp, Artificial sequence
  Synthetic oligonucleotide
gaaggaaaggttctgtggaa

SEQ ID NO: 1219 - DNA, 20 bp, Artificial sequence
  Synthetic oligonucleotide
ctgagtatttcaggctggaa

SEQ ID NO: 1220 - DNA, 20 bp, Artificial sequence
  Synthetic oligonucleotide
ttgaattatccctttaaaaa

SEQ ID NO: 1221 - DNA, 20 bp, Artificial sequence
  Synthetic oligonucleotide
tttagaatggtttggcatac

SEQ ID NO: 1222 - DNA, 20 bp, Artificial sequence
  Synthetic oligonucleotide
gatatgtccacattgattag

SEQ ID NO: 1223 - DNA, 20 bp, Artificial sequence
  Synthetic oligonucleotide
attatttaagcttctacttt

SEQ ID NO: 1224 - DNA, 20 bp, Artificial sequence
  Synthetic oligonucleotide
atacatggcaattaaaagat

SEQ ID NO: 1225 - DNA, 20 bp, Artificial sequence
  Synthetic oligonucleotide
tgagatagtgtgggaaatat

SEQ ID NO: 1226 - DNA, 20 bp, Artificial sequence
  Synthetic oligonucleotide
tatttttgtgttatgccttg

SEQ ID NO: 1227 - DNA, 20 bp, Artificial sequence
  Synthetic oligonucleotide
ttattaactagaatatgcct

SEQ ID NO: 1228 - DNA, 20 bp, Artificial sequence
  Synthetic oligonucleotide
gattattctatttttatttt

SEQ ID NO: 1229 - DNA, 20 bp, Artificial sequence
  Synthetic oligonucleotide
aggaagagtggcatggacat

SEQ ID NO: 1230 - DNA, 20 bp, Artificial sequence
  Synthetic oligonucleotide
cttttgcttatttacctggg

SEQ ID NO: 1231 - DNA, 20 bp, Artificial sequence
  Synthetic oligonucleotide
tttatattattaatatcatt

SEQ ID NO: 1232 - DNA, 20 bp, Artificial sequence
  Synthetic oligonucleotide
ggtacatggcttttaagtgg

SEQ ID NO: 1233 - DNA, 20 bp, Artificial sequence
  Synthetic oligonucleotide
aatattggtcaggtttaaga

SEQ ID NO: 1234 - DNA, 20 bp, Artificial sequence
  Synthetic oligonucleotide
atttcatctctttcttagtt

SEQ ID NO: 1235 - DNA, 20 bp, Artificial sequence
  Synthetic oligonucleotide
ccaatgatgttactactact

SEQ ID NO: 1236 - DNA, 20 bp, Artificial sequence
  Synthetic oligonucleotide
gttcccccaaccccttggaa

SEQ ID NO: 1237 - DNA, 20 bp, Artificial sequence
  Synthetic oligonucleotide
tataggaagtgagatgtatg

SEQ ID NO: 1238 - DNA, 20 bp, Artificial sequence
  Synthetic oligonucleotide
attattctagaagaagattt

SEQ ID NO: 1239 - DNA, 20 bp, Artificial sequence
  Synthetic oligonucleotide
atccccctagagcaatggtc

SEQ ID NO: 1240 - DNA, 20 bp, Artificial sequence
  Synthetic oligonucleotide
gaggctcacatttggaagac

SEQ ID NO: 1241 - DNA, 20 bp, Artificial sequence
  Synthetic oligonucleotide
tacacaaatccaaggcagag

SEQ ID NO: 1242 - DNA, 20 bp, Artificial sequence
  Synthetic oligonucleotide
aggaagagtgggagtgttac

SEQ ID NO: 1243 - DNA, 20 bp, Artificial sequence
  Synthetic oligonucleotide
gtccctgactaggcattttg

SEQ ID NO: 1244 - DNA, 20 bp, Artificial sequence
  Synthetic oligonucleotide
aagctcaattgcagatgctc

SEQ ID NO: 1245 - DNA, 20 bp, Artificial sequence
  Synthetic oligonucleotide
ctgtgagtccattaaacctc

SEQ ID NO: 1246 - DNA, 20 bp, Artificial sequence
  Synthetic oligonucleotide
tgaaatgtggctagtgtgac

SEQ ID NO: 1247 - DNA, 20 bp, Artificial sequence
  Synthetic oligonucleotide
aaaatattgaaaggcccatc

SEQ ID NO: 1248 - DNA, 20 bp, Artificial sequence
  Synthetic oligonucleotide
aatgtcaatagtgccctatt

SEQ ID NO: 1249 - DNA, 20 bp, Artificial sequence
  Synthetic oligonucleotide
acagtatattcagtccaagg

SEQ ID NO: 1250 - DNA, 20 bp, Artificial sequence
  Synthetic oligonucleotide
tgtctatttaagtttgttgc

SEQ ID NO: 1251 - DNA, 20 bp, Artificial sequence
  Synthetic oligonucleotide
ttcaagtactgtcatgaata

SEQ ID NO: 1252 - DNA, 20 bp, Artificial sequence
  Synthetic oligonucleotide
tttctttttcttaaactaag

SEQ ID NO: 1253 - DNA, 20 bp, Artificial sequence
  Synthetic oligonucleotide
gtttctattgttgccacctt

SEQ ID NO: 1254 - DNA, 20 bp, Artificial sequence
  Synthetic oligonucleotide
aaggccacatattatagtat

SEQ ID NO: 1255 - DNA, 20 bp, Artificial sequence
  Synthetic oligonucleotide
acctgaactattaatttctt

SEQ ID NO: 1256 - DNA, 20 bp, Artificial sequence
  Synthetic oligonucleotide
gaatgggctgagtagttgaa

SEQ ID NO: 1257 - DNA, 20 bp, Artificial sequence
  Synthetic oligonucleotide
tgatgaacattgctaatttg

SEQ ID NO: 1258 - DNA, 20 bp, Artificial sequence
  Synthetic oligonucleotide
atcttgcctcgatgaaagtt

SEQ ID NO: 1259 - DNA, 20 bp, Artificial sequence
  Synthetic oligonucleotide
ttaagtggcacagccatgat

SEQ ID NO: 1260 - DNA, 20 bp, Artificial sequence
  Synthetic oligonucleotide
aatgagttaagttggaacac

SEQ ID NO: 1261 - DNA, 20 bp, Artificial sequence
  Synthetic oligonucleotide
tccttagtagaatgcctgga

SEQ ID NO: 1262 - DNA, 20 bp, Artificial sequence
  Synthetic oligonucleotide
tatgtagaaaaataagctgg

SEQ ID NO: 1263 - DNA, 20 bp, Artificial sequence
  Synthetic oligonucleotide
gccgaggcaggcacctgagt

SEQ ID NO: 1264 - DNA, 20 bp, Artificial sequence
  Synthetic oligonucleotide
tggtacctatattgagaggt

SEQ ID NO: 1265 - DNA, 20 bp, Artificial sequence
  Synthetic oligonucleotide
ttaaggaaaaatatagtata

SEQ ID NO: 1266 - DNA, 20 bp, Artificial sequence
  Synthetic oligonucleotide
ttatttatgtgtcagggatg

SEQ ID NO: 1267 - DNA, 20 bp, Artificial sequence
  Synthetic oligonucleotide
caaaagttaagtgctttagg

SEQ ID NO: 1268 - DNA, 20 bp, Artificial sequence
  Synthetic oligonucleotide
ttcatagatgtctaaggaat

SEQ ID NO: 1269 - DNA, 20 bp, Artificial sequence
  Synthetic oligonucleotide
acctgtgatttacctatttc

SEQ ID NO: 1270 - DNA, 20 bp, Artificial sequence
  Synthetic oligonucleotide
tgcctagaaaaccacataaa

SEQ ID NO: 1271 - DNA, 20 bp, Artificial sequence
  Synthetic oligonucleotide
aaacatcctcaaaggtacct

SEQ ID NO: 1272 - DNA, 20 bp, Artificial sequence
  Synthetic oligonucleotide
cttccctgagacacacacat

SEQ ID NO: 1273 - DNA, 20 bp, Artificial sequence
  Synthetic oligonucleotide
cttcttcaatcttctcatac

SEQ ID NO: 1274 - DNA, 20 bp, Artificial sequence
  Synthetic oligonucleotide
taccattttccatttagttt

SEQ ID NO: 1275 - DNA, 20 bp, Artificial sequence
  Synthetic oligonucleotide
attggcatctttttcagtgg

SEQ ID NO: 1276 - DNA, 20 bp, Artificial sequence
  Synthetic oligonucleotide
tcaagctcacggttggagac

SEQ ID NO: 1277 - DNA, 20 bp, Artificial sequence
  Synthetic oligonucleotide
aaatgaaatcagtatgttga

SEQ ID NO: 1278 - DNA, 20 bp, Artificial sequence
  Synthetic oligonucleotide
tgatttatcacaaaggtgct

SEQ ID NO: 1279 - DNA, 20 bp, Artificial sequence
  Synthetic oligonucleotide
aaaacagtagaaaagattaa

SEQ ID NO: 1280 - DNA, 20 bp, Artificial sequence
  Synthetic oligonucleotide
ctacatcacagcagtcagaa

SEQ ID NO: 1281 - DNA, 20 bp, Artificial sequence
  Synthetic oligonucleotide
aaaagatgtaagtgtgacat

SEQ ID NO: 1282 - DNA, 20 bp, Artificial sequence
  Synthetic oligonucleotide
ttacaagaactgctaaaggg

SEQ ID NO: 1283 - DNA, 20 bp, Artificial sequence
  Synthetic oligonucleotide
ataaagaaaaagttaactga

SEQ ID NO: 1284 - DNA, 20 bp, Artificial sequence
  Synthetic oligonucleotide
agataatatacttcttctat

SEQ ID NO: 1285 - DNA, 20 bp, Artificial sequence
  Synthetic oligonucleotide
ccttcttcacatgtaaattg

SEQ ID NO: 1286 - DNA, 20 bp, Artificial sequence
  Synthetic oligonucleotide
tttctatgtagcttgtggtt

SEQ ID NO: 1287 - DNA, 20 bp, Artificial sequence
  Synthetic oligonucleotide
aggcagagtttttattgata

SEQ ID NO: 1288 - DNA, 20 bp, Artificial sequence
  Synthetic oligonucleotide
atagtcaccagcctaagcct

SEQ ID NO: 1289 - DNA, 20 bp, Artificial sequence
  Synthetic oligonucleotide
agacttttagcatgcttgac

SEQ ID NO: 1290 - DNA, 20 bp, Artificial sequence
  Synthetic oligonucleotide
tttacagccctacagttcta

SEQ ID NO: 1291 - DNA, 20 bp, Artificial sequence
  Synthetic oligonucleotide
ccagagaacctgactccaaa

SEQ ID NO: 1292 - DNA, 20 bp, Artificial sequence
  Synthetic oligonucleotide
cagaagaaaatattagacag

SEQ ID NO: 1293 - DNA, 20 bp, Artificial sequence
  Synthetic oligonucleotide
tattatacttctaaattccc

SEQ ID NO: 1294 - DNA, 20 bp, Artificial sequence
  Synthetic oligonucleotide
taaaagcaagaaaaaggaac

SEQ ID NO: 1295 - DNA, 20 bp, Artificial sequence
  Synthetic oligonucleotide
cctaatttatatgaacaaac

SEQ ID NO: 1296 - DNA, 20 bp, Artificial sequence
  Synthetic oligonucleotide
tgcaatgccttagcctaaaa

SEQ ID NO: 1297 - DNA, 20 bp, Artificial sequence
  Synthetic oligonucleotide
caccaccattattacactac

SEQ ID NO: 1298 - DNA, 20 bp, Artificial sequence
  Synthetic oligonucleotide
aaataaatcagattattata

SEQ ID NO: 1299 - DNA, 20 bp, Artificial sequence
  Synthetic oligonucleotide
cttagatctgtgctgtccaa

SEQ ID NO: 1300 - DNA, 20 bp, Artificial sequence
  Synthetic oligonucleotide
gttagtgttagattctttga

SEQ ID NO: 1301 - DNA, 20 bp, Artificial sequence
  Synthetic oligonucleotide
catgctcacggctgtgttac

SEQ ID NO: 1302 - DNA, 20 bp, Artificial sequence
  Synthetic oligonucleotide
cccatcaaatactgagttct

SEQ ID NO: 1303 - DNA, 20 bp, Artificial sequence
  Synthetic oligonucleotide
gaaagtagtgattaatgaga

SEQ ID NO: 1304 - DNA, 20 bp, Artificial sequence
  Synthetic oligonucleotide
attaatcaacaagtggcatt

SEQ ID NO: 1305 - DNA, 20 bp, Artificial sequence
  Synthetic oligonucleotide
tttaattttagggtttagag

SEQ ID NO: 1306 - DNA, 20 bp, Artificial sequence
  Synthetic oligonucleotide
cttgctaccactagagcctt

SEQ ID NO: 1307 - DNA, 20 bp, Artificial sequence
  Synthetic oligonucleotide
accactgacttatatcattt

SEQ ID NO: 1308 - DNA, 20 bp, Artificial sequence
  Synthetic oligonucleotide
ttccccattgctaattttgt

SEQ ID NO: 1309 - DNA, 20 bp, Artificial sequence
  Synthetic oligonucleotide
tcctgaaacttagtagctgg

SEQ ID NO: 1310 - DNA, 20 bp, Artificial sequence
  Synthetic oligonucleotide
tgtcttaaaaaggaataaaa

SEQ ID NO: 1311 - DNA, 20 bp, Artificial sequence
  Synthetic oligonucleotide
cctataataaagtattgtct

SEQ ID NO: 1312 - DNA, 20 bp, Artificial sequence
  Synthetic oligonucleotide
atgtaaaatggtatagctac

SEQ ID NO: 1313 - DNA, 20 bp, Artificial sequence
  Synthetic oligonucleotide
aaccctcacacacttctgtt

SEQ ID NO: 1314 - DNA, 20 bp, Artificial sequence
  Synthetic oligonucleotide
attctgcataagcagtgttt

SEQ ID NO: 1315 - DNA, 20 bp, Artificial sequence
  Synthetic oligonucleotide
ttactaccctgaagaagaac

SEQ ID NO: 1316 - DNA, 20 bp, Artificial sequence
  Synthetic oligonucleotide
aagacctataacttactacc

SEQ ID NO: 1317 - DNA, 20 bp, Artificial sequence
  Synthetic oligonucleotide
tttcacaagatttacttggt

SEQ ID NO: 1318 - DNA, 20 bp, Artificial sequence
  Synthetic oligonucleotide
cagttgtgattgtcaaccta

SEQ ID NO: 1319 - DNA, 20 bp, Artificial sequence
  Synthetic oligonucleotide
aatcttgcctcgatgaaagt

SEQ ID NO: 1320 - DNA, 20 bp, Artificial sequence
  Synthetic oligonucleotide
tggcctaaatgtatcagtta

SEQ ID NO: 1321 - DNA, 20 bp, Artificial sequence
  Synthetic oligonucleotide
aggctttgggtaaaatcttt

SEQ ID NO: 1322 - DNA, 20 bp, Artificial sequence
  Synthetic oligonucleotide
tatgatttttaaagattaaa

SEQ ID NO: 1323 - DNA, 20 bp, Artificial sequence
  Synthetic oligonucleotide
gtacagtgaaaaagatgtgt

SEQ ID NO: 1324 - DNA, 20 bp, Artificial sequence
  Synthetic oligonucleotide
gacaggtatgaagcaaaaca

SEQ ID NO: 1325 - DNA, 20 bp, Artificial sequence
  Synthetic oligonucleotide
tgagctgagggtctttgccg

SEQ ID NO: 1326 - DNA, 20 bp, Artificial sequence
  Synthetic oligonucleotide
aggctgagttgtacacaaac

SEQ ID NO: 1327 - DNA, 20 bp, Artificial sequence
  Synthetic oligonucleotide
atgaggaggctgagttgtac

SEQ ID NO: 1328 - DNA, 20 bp, Artificial sequence
  Synthetic oligonucleotide
tcataaagtgggcccagctt

SEQ ID NO: 1329 - DNA, 20 bp, Artificial sequence
  Synthetic oligonucleotide
actcctaatccctcagtttt

SEQ ID NO: 1330 - DNA, 20 bp, Artificial sequence
  Synthetic oligonucleotide
tttacatgcaaggagctgag

SEQ ID NO: 1331 - DNA, 20 bp, Artificial sequence
  Synthetic oligonucleotide
taatgccctttctccctact

SEQ ID NO: 1332 - DNA, 20 bp, Artificial sequence
  Synthetic oligonucleotide
cctgtttagattatcccaaa

SEQ ID NO: 1333 - DNA, 20 bp, Artificial sequence
  Synthetic oligonucleotide
catgattcacagaatttctc

SEQ ID NO: 1334 - DNA, 20 bp, Artificial sequence
  Synthetic oligonucleotide
agttagaaaactcaaagtat

SEQ ID NO: 1335 - DNA, 20 bp, Artificial sequence
  Synthetic oligonucleotide
tcaaatgtacttagcataag

SEQ ID NO: 1336 - DNA, 20 bp, Artificial sequence
  Synthetic oligonucleotide
atatcaaatgtacttagcat

SEQ ID NO: 1337 - DNA, 20 bp, Artificial sequence
  Synthetic oligonucleotide
aaagttcagaagagggaatg

SEQ ID NO: 1338 - DNA, 20 bp, Artificial sequence
  Synthetic oligonucleotide
aattcccatctgagtagttt

SEQ ID NO: 1339 - DNA, 20 bp, Artificial sequence
  Synthetic oligonucleotide
gtcccctaatttcaggctaa

SEQ ID NO: 1340 - DNA, 20 bp, Artificial sequence
  Synthetic oligonucleotide
ctatgtcaaatgaaacaaaa

SEQ ID NO: 1341 - DNA, 20 bp, Artificial sequence
  Synthetic oligonucleotide
tgattatgctttgtgataaa

SEQ ID NO: 1342 - DNA, 20 bp, Artificial sequence
  Synthetic oligonucleotide
tccagctgactaggagggct

SEQ ID NO: 1343 - DNA, 20 bp, Artificial sequence
  Synthetic oligonucleotide
cataccagtctcctcgctca

SEQ ID NO: 1344 - DNA, 20 bp, Artificial sequence
  Synthetic oligonucleotide
atataacagaatccaaccat

SEQ ID NO: 1345 - DNA, 20 bp, Artificial sequence
  Synthetic oligonucleotide
tgcaaaatggccaaactaca

SEQ ID NO: 1346 - DNA, 20 bp, Artificial sequence
  Synthetic oligonucleotide
tcttcctagccacatgtgat

SEQ ID NO: 1347 - DNA, 20 bp, Artificial sequence
  Synthetic oligonucleotide
taccatgctctctaattgcc

SEQ ID NO: 1348 - DNA, 20 bp, Artificial sequence
  Synthetic oligonucleotide
agtgatctgtgccaggctgc

SEQ ID NO: 1349 - DNA, 20 bp, Artificial sequence
  Synthetic oligonucleotide
aagttacagaacagatatct

SEQ ID NO: 1350 - DNA, 20 bp, Artificial sequence
  Synthetic oligonucleotide
gtattgtgaaaatagtactg

SEQ ID NO: 1351 - DNA, 20 bp, Artificial sequence
  Synthetic oligonucleotide
aaacactatcaagctcacgg

SEQ ID NO: 1352 - DNA, 20 bp, Artificial sequence
  Synthetic oligonucleotide
ttcaagaaaagtcttcaaat

SEQ ID NO: 1353 - DNA, 20 bp, Artificial sequence
  Synthetic oligonucleotide
ggatcatttccccatgcatg

SEQ ID NO: 1354 - DNA, 20 bp, Artificial sequence
  Synthetic oligonucleotide
atattatattaagaaaaatg

SEQ ID NO: 1355 - DNA, 20 bp, Artificial sequence
  Synthetic oligonucleotide
ctcccatgttcattacttat

SEQ ID NO: 1356 - DNA, 20 bp, Artificial sequence
  Synthetic oligonucleotide
catgacattggtttgggcaa

SEQ ID NO: 1357 - DNA, 20 bp, Artificial sequence
  Synthetic oligonucleotide
aatgttgttgggaaaattgg

SEQ ID NO: 1358 - DNA, 20 bp, Artificial sequence
  Synthetic oligonucleotide
agctgcaggatacaaagtca

SEQ ID NO: 1359 - DNA, 20 bp, Artificial sequence
  Synthetic oligonucleotide
atatcctttcatgataaaaa

SEQ ID NO: 1360 - DNA, 20 bp, Artificial sequence
  Synthetic oligonucleotide
atgggctaatatctctgata

SEQ ID NO: 1361 - DNA, 20 bp, Artificial sequence
  Synthetic oligonucleotide
acattactaataattagaga

SEQ ID NO: 1362 - DNA, 20 bp, Artificial sequence
  Synthetic oligonucleotide
ataaaaacatatgaaagtat

SEQ ID NO: 1363 - DNA, 20 bp, Artificial sequence
  Synthetic oligonucleotide
ttctgaattaaatctattag

SEQ ID NO: 1364 - DNA, 20 bp, Artificial sequence
  Synthetic oligonucleotide
ttacatttttgcaaatttat

SEQ ID NO: 1365 - DNA, 20 bp, Artificial sequence
  Synthetic oligonucleotide
tgaacagttgattaacaaag

SEQ ID NO: 1366 - DNA, 20 bp, Artificial sequence
  Synthetic oligonucleotide
aagttattggtttactagat

SEQ ID NO: 1367 - DNA, 20 bp, Artificial sequence
  Synthetic oligonucleotide
ttggaaaaggtcctagaaaa

SEQ ID NO: 1368 - DNA, 20 bp, Artificial sequence
  Synthetic oligonucleotide
catgacagaaacttcttaga

SEQ ID NO: 1369 - DNA, 20 bp, Artificial sequence
  Synthetic oligonucleotide
ccatacttgctgacaaatat

SEQ ID NO: 1370 - DNA, 16 bp, Artificial sequence
  Synthetic oligonucleotide
ttggtttgtcaatcct

SEQ ID NO: 1371 - DNA, 16 bp, Artificial sequence
  Synthetic oligonucleotide
ccgagcttcgcctctg

SEQ ID NO: 1372 - DNA, 16 bp, Artificial sequence
  Synthetic oligonucleotide
cctccgagcttcgcct

SEQ ID NO: 1373 - DNA, 16 bp, Artificial sequence
  Synthetic oligonucleotide
ggacctccgagcttcg

SEQ ID NO: 1374 - DNA, 16 bp, Artificial sequence
  Synthetic oligonucleotide
cctgtaggacctccga

SEQ ID NO: 1375 - DNA, 16 bp, Artificial sequence
  Synthetic oligonucleotide
ccagtgccaaggtcaa

SEQ ID NO: 1376 - DNA, 16 bp, Artificial sequence
  Synthetic oligonucleotide
cacttgatcctgccag

SEQ ID NO: 1377 - DNA, 16 bp, Artificial sequence
  Synthetic oligonucleotide
cacttccagaaaaagc

SEQ ID NO: 1378 - DNA, 16 bp, Artificial sequence
  Synthetic oligonucleotide
gtctctcgctcaggtg

SEQ ID NO: 1379 - DNA, 16 bp, Artificial sequence
  Synthetic oligonucleotide
aaagtctctcgctcag

SEQ ID NO: 1380 - DNA, 16 bp, Artificial sequence
  Synthetic oligonucleotide
atgaaaaagtctctcg

SEQ ID NO: 1381 - DNA, 16 bp, Artificial sequence
  Synthetic oligonucleotide
tccttctggtatagaa

SEQ ID NO: 1382 - DNA, 16 bp, Artificial sequence
  Synthetic oligonucleotide
caataaggtatccaga

SEQ ID NO: 1383 - DNA, 16 bp, Artificial sequence
  Synthetic oligonucleotide
cttgatacaataaggt

SEQ ID NO: 1384 - DNA, 16 bp, Artificial sequence
  Synthetic oligonucleotide
ctagttagcttgatac

SEQ ID NO: 1385 - DNA, 16 bp, Artificial sequence
  Synthetic oligonucleotide
gatctggttgcactat

SEQ ID NO: 1386 - DNA, 16 bp, Artificial sequence
  Synthetic oligonucleotide
ggcaatgggtggatct

SEQ ID NO: 1387 - DNA, 16 bp, Artificial sequence
  Synthetic oligonucleotide
ccagttgagggcaatg

SEQ ID NO: 1388 - DNA, 16 bp, Artificial sequence
  Synthetic oligonucleotide
taaagtccagttgagg

SEQ ID NO: 1389 - DNA, 16 bp, Artificial sequence
  Synthetic oligonucleotide
tacatagagcacctca

SEQ ID NO: 1390 - DNA, 16 bp, Artificial sequence
  Synthetic oligonucleotide
tgttacatagagcacc

SEQ ID NO: 1391 - DNA, 16 bp, Artificial sequence
  Synthetic oligonucleotide
aagtgttacatagagc

SEQ ID NO: 1392 - DNA, 16 bp, Artificial sequence
  Synthetic oligonucleotide
cttcacatgtaaattg

SEQ ID NO: 1393 - DNA, 16 bp, Artificial sequence
  Synthetic oligonucleotide
gagccatggaaagtag

SEQ ID NO: 1394 - DNA, 16 bp, Artificial sequence
  Synthetic oligonucleotide
ccttccttgaggagat

SEQ ID NO: 1395 - DNA, 16 bp, Artificial sequence
  Synthetic oligonucleotide
cttcacccctaggtta

SEQ ID NO: 1396 - DNA, 16 bp, Artificial sequence
  Synthetic oligonucleotide
ccatccttcaccccta

SEQ ID NO: 1397 - DNA, 16 bp, Artificial sequence
  Synthetic oligonucleotide
gtcgccatccttcacc

SEQ ID NO: 1398 - DNA, 16 bp, Artificial sequence
  Synthetic oligonucleotide
ccagagtcgccatcct

SEQ ID NO: 1399 - DNA, 16 bp, Artificial sequence
  Synthetic oligonucleotide
gtggctgagcaacctc

SEQ ID NO: 1400 - DNA, 16 bp, Artificial sequence
  Synthetic oligonucleotide
cccttttaacctctgt

SEQ ID NO: 1401 - DNA, 16 bp, Artificial sequence
  Synthetic oligonucleotide
catcatgataaggtga

SEQ ID NO: 1402 - DNA, 16 bp, Artificial sequence
  Synthetic oligonucleotide
tggataacactgggct

SEQ ID NO: 1403 - DNA, 16 bp, Artificial sequence
  Synthetic oligonucleotide
tctgcttggataacac

SEQ ID NO: 1404 - DNA, 16 bp, Artificial sequence
  Synthetic oligonucleotide
gaatatgggcagcttg

SEQ ID NO: 1405 - DNA, 16 bp, Artificial sequence
  Synthetic oligonucleotide
agctgaatatgggcag

SEQ ID NO: 1406 - DNA, 16 bp, Artificial sequence
  Synthetic oligonucleotide
ttgcttagctgaatat

SEQ ID NO: 1407 - DNA, 16 bp, Artificial sequence
  Synthetic oligonucleotide
tggattgcttagctga

SEQ ID NO: 1408 - DNA, 16 bp, Artificial sequence
  Synthetic oligonucleotide
acttggattgcttagc

SEQ ID NO: 1409 - DNA, 16 bp, Artificial sequence
  Synthetic oligonucleotide
agtgaacttggattgc

SEQ ID NO: 1410 - DNA, 16 bp, Artificial sequence
  Synthetic oligonucleotide
ggcataaaagtcgatg

SEQ ID NO: 1411 - DNA, 16 bp, Artificial sequence
  Synthetic oligonucleotide
ctgggcataaaagtcg

SEQ ID NO: 1412 - DNA, 16 bp, Artificial sequence
  Synthetic oligonucleotide
ggaaaggaccacacta

SEQ ID NO: 1413 - DNA, 16 bp, Artificial sequence
  Synthetic oligonucleotide
gagtgagaccatttcc

SEQ ID NO: 1414 - DNA, 16 bp, Artificial sequence
  Synthetic oligonucleotide
gatgtgaggagccaca

SEQ ID NO: 1415 - DNA, 16 bp, Artificial sequence
  Synthetic oligonucleotide
cttgatgtgaggagcc

SEQ ID NO: 1416 - DNA, 16 bp, Artificial sequence
  Synthetic oligonucleotide
tcaaccttgatgtgag

SEQ ID NO: 1417 - DNA, 16 bp, Artificial sequence
  Synthetic oligonucleotide
tgattcaaccttgatg

SEQ ID NO: 1418 - DNA, 16 bp, Artificial sequence
  Synthetic oligonucleotide
gtgtgattcaaccttg

SEQ ID NO: 1419 - DNA, 16 bp, Artificial sequence
  Synthetic oligonucleotide
tatgtgtgattcaacc

SEQ ID NO: 1420 - DNA, 16 bp, Artificial sequence
  Synthetic oligonucleotide
ggcatctcagaacctg

SEQ ID NO: 1421 - DNA, 16 bp, Artificial sequence
  Synthetic oligonucleotide
ggtatagtctgggaca

SEQ ID NO: 1422 - DNA, 16 bp, Artificial sequence
  Synthetic oligonucleotide
tggaggtatagtctgg

SEQ ID NO: 1423 - DNA, 16 bp, Artificial sequence
  Synthetic oligonucleotide
gaatggaggtatagtc

SEQ ID NO: 1424 - DNA, 16 bp, Artificial sequence
  Synthetic oligonucleotide
tatgaatggaggtata

SEQ ID NO: 1425 - DNA, 16 bp, Artificial sequence
  Synthetic oligonucleotide
ctatatgaatggaggt

SEQ ID NO: 1426 - DNA, 16 bp, Artificial sequence
  Synthetic oligonucleotide
gtactatatgaatgga

SEQ ID NO: 1427 - DNA, 16 bp, Artificial sequence
  Synthetic oligonucleotide
gggactgtactatatg

SEQ ID NO: 1428 - DNA, 16 bp, Artificial sequence
  Synthetic oligonucleotide
ttacattgcacaatag

SEQ ID NO: 1429 - DNA, 16 bp, Artificial sequence
  Synthetic oligonucleotide
tagccatgcttgaagt

SEQ ID NO: 1430 - DNA, 16 bp, Artificial sequence
  Synthetic oligonucleotide
tgtgtagtgtaatata

SEQ ID NO: 1431 - DNA, 16 bp, Artificial sequence
  Synthetic oligonucleotide
acagtgtgtagtgtaa

SEQ ID NO: 1432 - DNA, 16 bp, Artificial sequence
  Synthetic oligonucleotide
gcagtacacagtgtgt

SEQ ID NO: 1433 - DNA, 16 bp, Artificial sequence
  Synthetic oligonucleotide
actgcagtacacagtg

SEQ ID NO: 1434 - DNA, 16 bp, Artificial sequence
  Synthetic oligonucleotide
ttagactgtagttgct

SEQ ID NO: 1435 - DNA, 16 bp, Artificial sequence
  Synthetic oligonucleotide
ccagctttagactgta

SEQ ID NO: 1436 - DNA, 16 bp, Artificial sequence
  Synthetic oligonucleotide
taaaccagctttagac

SEQ ID NO: 1437 - DNA, 16 bp, Artificial sequence
  Synthetic oligonucleotide
aacattaaaccagctt

SEQ ID NO: 1438 - DNA, 16 bp, Artificial sequence
  Synthetic oligonucleotide
actacaatcattttag

SEQ ID NO: 1439 - DNA, 16 bp, Artificial sequence
  Synthetic oligonucleotide
gattactacaatcatt

SEQ ID NO: 1440 - DNA, 16 bp, Artificial sequence
  Synthetic oligonucleotide
aatgcagattactaca

SEQ ID NO: 1441 - DNA, 16 bp, Artificial sequence
  Synthetic oligonucleotide
tccaataatgcagatt

SEQ ID NO: 1442 - DNA, 16 bp, Artificial sequence
  Synthetic oligonucleotide
gttgatctgtgcaaac

SEQ ID NO: 1443 - DNA, 16 bp, Artificial sequence
  Synthetic oligonucleotide
tctacttctcttagca

SEQ ID NO: 1444 - DNA, 16 bp, Artificial sequence
  Synthetic oligonucleotide
gcttcttgtaccttat

SEQ ID NO: 1445 - DNA, 16 bp, Artificial sequence
  Synthetic oligonucleotide
gatttgcttcaactta

SEQ ID NO: 1446 - DNA, 16 bp, Artificial sequence
  Synthetic oligonucleotide
ggttataggctgtgaa

SEQ ID NO: 1447 - DNA, 16 bp, Artificial sequence
  Synthetic oligonucleotide
tctggttataggctgt

SEQ ID NO: 1448 - DNA, 16 bp, Artificial sequence
  Synthetic oligonucleotide
gtgtctggttataggc

SEQ ID NO: 1449 - DNA, 16 bp, Artificial sequence
  Synthetic oligonucleotide
agtatgtgtctggtta

SEQ ID NO: 1450 - DNA, 16 bp, Artificial sequence
  Synthetic oligonucleotide
gggactgaaaaccttg

SEQ ID NO: 1451 - DNA, 16 bp, Artificial sequence
  Synthetic oligonucleotide
agtattcttcactgag

SEQ ID NO: 1452 - DNA, 16 bp, Artificial sequence
  Synthetic oligonucleotide
gcgataaatgggaaat

SEQ ID NO: 1453 - DNA, 16 bp, Artificial sequence
  Synthetic oligonucleotide
gtctgcgataaatggg

SEQ ID NO: 1454 - DNA, 16 bp, Artificial sequence
  Synthetic oligonucleotide
cctaaaaaaggtctgc

SEQ ID NO: 1455 - DNA, 16 bp, Artificial sequence
  Synthetic oligonucleotide
cattaagcttgcttcc

SEQ ID NO: 1456 - DNA, 16 bp, Artificial sequence
  Synthetic oligonucleotide
cacaactagtcatact

SEQ ID NO: 1457 - DNA, 16 bp, Artificial sequence
  Synthetic oligonucleotide
aactgccagacacaac

SEQ ID NO: 1458 - DNA, 16 bp, Artificial sequence
  Synthetic oligonucleotide
ataaactgccagacac

SEQ ID NO: 1459 - DNA, 16 bp, Artificial sequence
  Synthetic oligonucleotide
tatcaggaatccaaga

SEQ ID NO: 1460 - DNA, 16 bp, Artificial sequence
  Synthetic oligonucleotide
ttgataacagaagcac

SEQ ID NO: 1461 - DNA, 16 bp, Artificial sequence
  Synthetic oligonucleotide
ttggtgtttgataaca

SEQ ID NO: 1462 - DNA, 16 bp, Artificial sequence
  Synthetic oligonucleotide
atgttggtgtttgata

SEQ ID NO: 1463 - DNA, 16 bp, Artificial sequence
  Synthetic oligonucleotide
ccgccactgtagcagc

SEQ ID NO: 1464 - DNA, 16 bp, Artificial sequence
  Synthetic oligonucleotide
cgccaccgccactgta

SEQ ID NO: 1465 - DNA, 16 bp, Artificial sequence
  Synthetic oligonucleotide
gccgcccgggctcagc

SEQ ID NO: 1466 - DNA, 16 bp, Artificial sequence
  Synthetic oligonucleotide
cgccgccgcccgggct

SEQ ID NO: 1467 - DNA, 16 bp, Artificial sequence
  Synthetic oligonucleotide
gagagcgcgggttcgc

SEQ ID NO: 1468 - DNA, 16 bp, Artificial sequence
  Synthetic oligonucleotide
ctactgaccccagttc

SEQ ID NO: 1469 - DNA, 16 bp, Artificial sequence
  Synthetic oligonucleotide
tcactctactgacccc

SEQ ID NO: 1470 - DNA, 16 bp, Artificial sequence
  Synthetic oligonucleotide
tcatgcggactggtgg

SEQ ID NO: 1471 - DNA, 16 bp, Artificial sequence
  Synthetic oligonucleotide
atgtgagcatggaccc

SEQ ID NO: 1472 - DNA, 16 bp, Artificial sequence
  Synthetic oligonucleotide
tcttgatatgtgagca

SEQ ID NO: 1473 - DNA, 16 bp, Artificial sequence
  Synthetic oligonucleotide
ttcaagttggtgagct

SEQ ID NO: 1474 - DNA, 16 bp, Artificial sequence
  Synthetic oligonucleotide
tgcttccttcaagttg

SEQ ID NO: 1475 - DNA, 16 bp, Artificial sequence
  Synthetic oligonucleotide
tgtaatttcattcatg

SEQ ID NO: 1476 - DNA, 16 bp, Artificial sequence
  Synthetic oligonucleotide
ccttttgccaagagca

SEQ ID NO: 1477 - DNA, 16 bp, Artificial sequence
  Synthetic oligonucleotide
gatccttttgccaaga

SEQ ID NO: 1478 - DNA, 16 bp, Artificial sequence
  Synthetic oligonucleotide
gctagtaatgttacat

SEQ ID NO: 1479 - DNA, 16 bp, Artificial sequence
  Synthetic oligonucleotide
gcaacttgctagtaat

SEQ ID NO: 1480 - DNA, 16 bp, Artificial sequence
  Synthetic oligonucleotide
tgtgcaacttgctagt

SEQ ID NO: 1481 - DNA, 16 bp, Artificial sequence
  Synthetic oligonucleotide
ggatttcagtttgaat

SEQ ID NO: 1482 - DNA, 16 bp, Artificial sequence
  Synthetic oligonucleotide
ctcagagccttggtag

SEQ ID NO: 1483 - DNA, 16 bp, Artificial sequence
  Synthetic oligonucleotide
caaacgcgcaaaagac

SEQ ID NO: 1484 - DNA, 16 bp, Artificial sequence
  Synthetic oligonucleotide
gcccgcacaaacgcgc

SEQ ID NO: 1485 - DNA, 16 bp, Artificial sequence
  Synthetic oligonucleotide
ggttaaagaagttgct

SEQ ID NO: 1486 - DNA, 16 bp, Artificial sequence
  Synthetic oligonucleotide
cccagtgaattcagca

SEQ ID NO: 1487 - DNA, 16 bp, Artificial sequence
  Synthetic oligonucleotide
gcgcccagtgaattca

SEQ ID NO: 1488 - DNA, 16 bp, Artificial sequence
  Synthetic oligonucleotide
aagatgcgcccagtga

SEQ ID NO: 1489 - DNA, 16 bp, Artificial sequence
  Synthetic oligonucleotide
tgtaagatgcgcccag

SEQ ID NO: 1490 - DNA, 16 bp, Artificial sequence
  Synthetic oligonucleotide
aattacttgtaagatg

SEQ ID NO: 1491 - DNA, 16 bp, Artificial sequence
  Synthetic oligonucleotide
cccagaaggcacttgt

SEQ ID NO: 1492 - DNA, 16 bp, Artificial sequence
  Synthetic oligonucleotide
ttgcagaacaaatctt

SEQ ID NO: 1493 - DNA, 16 bp, Artificial sequence
  Synthetic oligonucleotide
catggaagatttgcag

SEQ ID NO: 1494 - DNA, 16 bp, Artificial sequence
  Synthetic oligonucleotide
ggtcatggaagatttg

SEQ ID NO: 1495 - DNA, 16 bp, Artificial sequence
  Synthetic oligonucleotide
gaccttggtcatggaa

SEQ ID NO: 1496 - DNA, 16 bp, Artificial sequence
  Synthetic oligonucleotide
tgccaatccaaagagg

SEQ ID NO: 1497 - DNA, 16 bp, Artificial sequence
  Synthetic oligonucleotide
gggtctgccaatccaa

SEQ ID NO: 1498 - DNA, 16 bp, Artificial sequence
  Synthetic oligonucleotide
tccctgggtctgccaa

SEQ ID NO: 1499 - DNA, 16 bp, Artificial sequence
  Synthetic oligonucleotide
aagtgtgaatttatct

SEQ ID NO: 1500 - DNA, 16 bp, Artificial sequence
  Synthetic oligonucleotide
ggagatctcaacaagg

SEQ ID NO: 1501 - DNA, 16 bp, Artificial sequence
  Synthetic oligonucleotide
tcgcccatcactcttc

SEQ ID NO: 1502 - DNA, 16 bp, Artificial sequence
  Synthetic oligonucleotide
cctgtcgcccatcact

SEQ ID NO: 1503 - DNA, 16 bp, Artificial sequence
  Synthetic oligonucleotide
tcacctgtcgcccatc

SEQ ID NO: 1504 - DNA, 16 bp, Artificial sequence
  Synthetic oligonucleotide
ccatcacctgtcgccc

SEQ ID NO: 1505 - DNA, 16 bp, Artificial sequence
  Synthetic oligonucleotide
tcaccatcacctgtcg

SEQ ID NO: 1506 - DNA, 16 bp, Artificial sequence
  Synthetic oligonucleotide
taatagttgtcaccat

SEQ ID NO: 1507 - DNA, 16 bp, Artificial sequence
  Synthetic oligonucleotide
ttcagatcttattaat

SEQ ID NO: 1508 - DNA, 16 bp, Artificial sequence
  Synthetic oligonucleotide
ttgcaaattcagtctg

SEQ ID NO: 1509 - DNA, 16 bp, Artificial sequence
  Synthetic oligonucleotide
cgttctcttggaagta

SEQ ID NO: 1510 - DNA, 16 bp, Artificial sequence
  Synthetic oligonucleotide
tcttgaataaatttcg

SEQ ID NO: 1511 - DNA, 16 bp, Artificial sequence
  Synthetic oligonucleotide
aagctcactcttcaat

SEQ ID NO: 1512 - DNA, 16 bp, Artificial sequence
  Synthetic oligonucleotide
tccaagctcactcttc

SEQ ID NO: 1513 - DNA, 16 bp, Artificial sequence
  Synthetic oligonucleotide
gctcctgccactctgt

SEQ ID NO: 1514 - DNA, 16 bp, Artificial sequence
  Synthetic oligonucleotide
atgggcaaaggcatct

SEQ ID NO: 1515 - DNA, 16 bp, Artificial sequence
  Synthetic oligonucleotide
agtcttcccggcgagg

SEQ ID NO: 1516 - DNA, 16 bp, Artificial sequence
  Synthetic oligonucleotide
ccgccgctccctagcc

SEQ ID NO: 1517 - DNA, 16 bp, Artificial sequence
  Synthetic oligonucleotide
gcccgcaactccctgc

SEQ ID NO: 1518 - DNA, 16 bp, Artificial sequence
  Synthetic oligonucleotide
cgcctccccaggcgca

SEQ ID NO: 1519 - DNA, 16 bp, Artificial sequence
  Synthetic oligonucleotide
gagtgtcttcccaggc

SEQ ID NO: 1520 - DNA, 16 bp, Artificial sequence
  Synthetic oligonucleotide
ctgaagactccttgaa

SEQ ID NO: 1521 - DNA, 16 bp, Artificial sequence
  Synthetic oligonucleotide
ggctagccaagttgga

SEQ ID NO: 1522 - DNA, 16 bp, Artificial sequence
  Synthetic oligonucleotide
tgactccagtcttacc

SEQ ID NO: 1523 - DNA, 16 bp, Artificial sequence
  Synthetic oligonucleotide
attcattgtggtcagc

SEQ ID NO: 1524 - DNA, 16 bp, Artificial sequence
  Synthetic oligonucleotide
gaagtgggtttttccc

SEQ ID NO: 1525 - DNA, 16 bp, Artificial sequence
  Synthetic oligonucleotide
gccttggttcaggtga

SEQ ID NO: 1526 - DNA, 16 bp, Artificial sequence
  Synthetic oligonucleotide
ccactgtagcagccgc

SEQ ID NO: 1527 - DNA, 16 bp, Artificial sequence
  Synthetic oligonucleotide
taggtatttcagagcc

SEQ ID NO: 1528 - DNA, 16 bp, Artificial sequence
  Synthetic oligonucleotide
gtccaggcagagttgt

SEQ ID NO: 1529 - DNA, 16 bp, Artificial sequence
  Synthetic oligonucleotide
agccaaatgttggtca

SEQ ID NO: 1530 - DNA, 16 bp, Artificial sequence
  Synthetic oligonucleotide
gagggcgagtttttcc

SEQ ID NO: 1531 - DNA, 16 bp, Artificial sequence
  Synthetic oligonucleotide
gtggcattggcaagcc

SEQ ID NO: 1532 - DNA, 16 bp, Artificial sequence
  Synthetic oligonucleotide
accccactgcaccaag

SEQ ID NO: 1533 - DNA, 16 bp, Artificial sequence
  Synthetic oligonucleotide
tccaagtacttgccaa

SEQ ID NO: 1534 - DNA, 16 bp, Artificial sequence
  Synthetic oligonucleotide
agtgcctggcctaagg

SEQ ID NO: 1535 - DNA, 16 bp, Artificial sequence
  Synthetic oligonucleotide
gcgcttcttccctagg

SEQ ID NO: 1536 - DNA, 16 bp, Artificial sequence
  Synthetic oligonucleotide
catcttgcccagggat

SEQ ID NO: 1537 - DNA, 16 bp, Artificial sequence
  Synthetic oligonucleotide
ccatcttgctccaagt

SEQ ID NO: 1538 - DNA, 16 bp, Artificial sequence
  Synthetic oligonucleotide
cttacatcctgtaggc

SEQ ID NO: 1539 - DNA, 16 bp, Artificial sequence
  Synthetic oligonucleotide
cgcctcctggtcctca

SEQ ID NO: 1540 - DNA, 16 bp, Artificial sequence
  Synthetic oligonucleotide
ccctatgcactaccta

SEQ ID NO: 1541 - DNA, 16 bp, Artificial sequence
  Synthetic oligonucleotide
gagggactgtggtgct

SEQ ID NO: 1542 - DNA, 16 bp, Artificial sequence
  Synthetic oligonucleotide
gcccaatatgtgccag

SEQ ID NO: 1543 - DNA, 16 bp, Artificial sequence
  Synthetic oligonucleotide
gctctctcatcgctgg

SEQ ID NO: 1544 - DNA, 16 bp, Artificial sequence
  Synthetic oligonucleotide
ctcaaggctatgtgcc

SEQ ID NO: 1545 - DNA, 16 bp, Artificial sequence
  Synthetic oligonucleotide
tccacatccctcatgt

SEQ ID NO: 1546 - DNA, 16 bp, Artificial sequence
  Synthetic oligonucleotide
aggactgaaggcccat

SEQ ID NO: 1547 - DNA, 16 bp, Artificial sequence
  Synthetic oligonucleotide
gtgcgacttaccagct

SEQ ID NO: 1548 - DNA, 16 bp, Artificial sequence
  Synthetic oligonucleotide
tcgctaaagccacaca

SEQ ID NO: 1549 - DNA, 16 bp, Artificial sequence
  Synthetic oligonucleotide
gctctggctgatggtc

SEQ ID NO: 1550 - DNA, 16 bp, Artificial sequence
  Synthetic oligonucleotide
ttcccatgaggatttc

SEQ ID NO: 1551 - DNA, 16 bp, Artificial sequence
  Synthetic oligonucleotide
ttgggcttaagcacta

SEQ ID NO: 1552 - DNA, 16 bp, Artificial sequence
  Synthetic oligonucleotide
gctagcacctagtcca

SEQ ID NO: 1553 - DNA, 16 bp, Artificial sequence
  Synthetic oligonucleotide
cctctggcctacaaca

SEQ ID NO: 1554 - DNA, 16 bp, Artificial sequence
  Synthetic oligonucleotide
acccctcatcagcacc

SEQ ID NO: 1555 - DNA, 16 bp, Artificial sequence
  Synthetic oligonucleotide
ggccacccctgatcct

SEQ ID NO: 1556 - DNA, 16 bp, Artificial sequence
  Synthetic oligonucleotide
gaagctcccttgccca

SEQ ID NO: 1557 - DNA, 16 bp, Artificial sequence
  Synthetic oligonucleotide
agtgttgcccctccaa

SEQ ID NO: 1558 - DNA, 16 bp, Artificial sequence
  Synthetic oligonucleotide
gggtctccaacctact

SEQ ID NO: 1559 - DNA, 16 bp, Artificial sequence
  Synthetic oligonucleotide
gggatgtaggtttacc

SEQ ID NO: 1560 - DNA, 16 bp, Artificial sequence
  Synthetic oligonucleotide
gcaaccgatatcacag

SEQ ID NO: 1561 - DNA, 16 bp, Artificial sequence
  Synthetic oligonucleotide
tgccctggaacaaatt

SEQ ID NO: 1562 - DNA, 16 bp, Artificial sequence
  Synthetic oligonucleotide
agtctaggagtagcta

SEQ ID NO: 1563 - DNA, 16 bp, Artificial sequence
  Synthetic oligonucleotide
gctgttgtcaagagac

SEQ ID NO: 1564 - DNA, 16 bp, Artificial sequence
  Synthetic oligonucleotide
cacctagacactcagt

SEQ ID NO: 1565 - DNA, 16 bp, Artificial sequence
  Synthetic oligonucleotide
gtcaagggatccctgc

SEQ ID NO: 1566 - DNA, 16 bp, Artificial sequence
  Synthetic oligonucleotide
tccccctggcactcca

SEQ ID NO: 1567 - DNA, 16 bp, Artificial sequence
  Synthetic oligonucleotide
gcctggtaactccatt

SEQ ID NO: 1568 - DNA, 16 bp, Artificial sequence
  Synthetic oligonucleotide
gggctcaccaactgtg

SEQ ID NO: 1569 - DNA, 16 bp, Artificial sequence
  Synthetic oligonucleotide
ccacaggatcatatca

SEQ ID NO: 1570 - DNA, 16 bp, Artificial sequence
  Synthetic oligonucleotide
ctccagcagaagtgtc

SEQ ID NO: 1571 - DNA, 16 bp, Artificial sequence
  Synthetic oligonucleotide
agcccaactgttgcct

SEQ ID NO: 1572 - DNA, 16 bp, Artificial sequence
  Synthetic oligonucleotide
tgccaggcagttgcca

SEQ ID NO: 1573 - DNA, 16 bp, Artificial sequence
  Synthetic oligonucleotide
gccagtaagcaccttg

SEQ ID NO: 1574 - DNA, 16 bp, Artificial sequence
  Synthetic oligonucleotide
ctagcttcccagcccc

SEQ ID NO: 1575 - DNA, 16 bp, Artificial sequence
  Synthetic oligonucleotide
tcaagcccagctagca

SEQ ID NO: 1576 - DNA, 16 bp, Artificial sequence
  Synthetic oligonucleotide
cctcacaggccctaat

SEQ ID NO: 1577 - DNA, 16 bp, Artificial sequence
  Synthetic oligonucleotide
acctgcttacatggta

SEQ ID NO: 1578 - DNA, 16 bp, Artificial sequence
  Synthetic oligonucleotide
cctttgctaggaccca

SEQ ID NO: 1579 - DNA, 16 bp, Artificial sequence
  Synthetic oligonucleotide
gggactgccaccaagg

SEQ ID NO: 1580 - DNA, 16 bp, Artificial sequence
  Synthetic oligonucleotide
gctagatgttcaggcc

SEQ ID NO: 1581 - DNA, 16 bp, Artificial sequence
  Synthetic oligonucleotide
cctatggccatgctga

SEQ ID NO: 1582 - DNA, 16 bp, Artificial sequence
  Synthetic oligonucleotide
gtatgctagttcccat

SEQ ID NO: 1583 - DNA, 16 bp, Artificial sequence
  Synthetic oligonucleotide
ccctcataatcttggg

SEQ ID NO: 1584 - DNA, 16 bp, Artificial sequence
  Synthetic oligonucleotide
gtccaaccactaccac

SEQ ID NO: 1585 - DNA, 16 bp, Artificial sequence
  Synthetic oligonucleotide
acttgcagatagctga

SEQ ID NO: 1586 - DNA, 16 bp, Artificial sequence
  Synthetic oligonucleotide
gcatgaccccactgcc

SEQ ID NO: 1587 - DNA, 16 bp, Artificial sequence
  Synthetic oligonucleotide
gagggtcacattccct

SEQ ID NO: 1588 - DNA, 16 bp, Artificial sequence
  Synthetic oligonucleotide
tctcttactggtgggt

SEQ ID NO: 1589 - DNA, 16 bp, Artificial sequence
  Synthetic oligonucleotide
gcccccttcctggata

SEQ ID NO: 1590 - DNA, 16 bp, Artificial sequence
  Synthetic oligonucleotide
cctcatgcgacaccac

SEQ ID NO: 1591 - DNA, 16 bp, Artificial sequence
  Synthetic oligonucleotide
agccctctgcctgtaa

SEQ ID NO: 1592 - DNA, 16 bp, Artificial sequence
  Synthetic oligonucleotide
ctcccagctataggcg

SEQ ID NO: 1593 - DNA, 16 bp, Artificial sequence
  Synthetic oligonucleotide
gctagctgcgcaagga

SEQ ID NO: 1594 - DNA, 16 bp, Artificial sequence
  Synthetic oligonucleotide
gcgcagcccgctgcaa

SEQ ID NO: 1595 - DNA, 16 bp, Artificial sequence
  Synthetic oligonucleotide
tgcatgatccacccca

SEQ ID NO: 1596 - DNA, 16 bp, Artificial sequence
  Synthetic oligonucleotide
gcttagtgctggccca

SEQ ID NO: 1597 - DNA, 16 bp, Artificial sequence
  Synthetic oligonucleotide
ccttccagtcctcata

SEQ ID NO: 1598 - DNA, 16 bp, Artificial sequence
  Synthetic oligonucleotide
atagtgtcaaggccca

SEQ ID NO: 1599 - DNA, 16 bp, Artificial sequence
  Synthetic oligonucleotide
aggccttagtcaccca

SEQ ID NO: 1600 - DNA, 16 bp, Artificial sequence
  Synthetic oligonucleotide
taaccaacctaaggga

SEQ ID NO: 1601 - DNA, 16 bp, Artificial sequence
  Synthetic oligonucleotide
attctggtgatgccct

SEQ ID NO: 1602 - DNA, 16 bp, Artificial sequence
  Synthetic oligonucleotide
gtgttcactgccatga

SEQ ID NO: 1603 - DNA, 16 bp, Artificial sequence
  Synthetic oligonucleotide
ggtagagcacactgcc

SEQ ID NO: 1604 - DNA, 16 bp, Artificial sequence
  Synthetic oligonucleotide
ccactttaatgccacc

SEQ ID NO: 1605 - DNA, 16 bp, Artificial sequence
  Synthetic oligonucleotide
gtcaaatgctgttggg

SEQ ID NO: 1606 - DNA, 16 bp, Artificial sequence
  Synthetic oligonucleotide
catcccctatcagggt

SEQ ID NO: 1607 - DNA, 16 bp, Artificial sequence
  Synthetic oligonucleotide
ctcgaatcccttgagc

SEQ ID NO: 1608 - DNA, 16 bp, Artificial sequence
  Synthetic oligonucleotide
gattccctcccctaac

SEQ ID NO: 1609 - DNA, 16 bp, Artificial sequence
  Synthetic oligonucleotide
atccatccatgtgctg

SEQ ID NO: 1610 - DNA, 16 bp, Artificial sequence
  Synthetic oligonucleotide
gagcatgcctcagtgg

SEQ ID NO: 1611 - DNA, 16 bp, Artificial sequence
  Synthetic oligonucleotide
cagaaggactgcctct

SEQ ID NO: 1612 - DNA, 16 bp, Artificial sequence
  Synthetic oligonucleotide
acaatgctcaacagcc

SEQ ID NO: 1613 - DNA, 16 bp, Artificial sequence
  Synthetic oligonucleotide
gttggatctggcatgc

SEQ ID NO: 1614 - DNA, 16 bp, Artificial sequence
  Synthetic oligonucleotide
cggctgagagcaaggg

SEQ ID NO: 1615 - DNA, 16 bp, Artificial sequence
  Synthetic oligonucleotide
gagagggttcagcctg

SEQ ID NO: 1616 - DNA, 16 bp, Artificial sequence
  Synthetic oligonucleotide
acttagttcctagcca

SEQ ID NO: 1617 - DNA, 16 bp, Artificial sequence
  Synthetic oligonucleotide
gtgaaccagatgtgct

SEQ ID NO: 1618 - DNA, 16 bp, Artificial sequence
  Synthetic oligonucleotide
ggagtgacagctaagt

SEQ ID NO: 1619 - DNA, 16 bp, Artificial sequence
  Synthetic oligonucleotide
aagtgttcagagccac

SEQ ID NO: 1620 - DNA, 16 bp, Artificial sequence
  Synthetic oligonucleotide
aaccctgccaaggtac

SEQ ID NO: 1621 - DNA, 16 bp, Artificial sequence
  Synthetic oligonucleotide
gatggtgagcactacc

SEQ ID NO: 1622 - DNA, 16 bp, Artificial sequence
  Synthetic oligonucleotide
ggcaggataggacaga

SEQ ID NO: 1623 - DNA, 16 bp, Artificial sequence
  Synthetic oligonucleotide
gcaaagtgatgagcct

SEQ ID NO: 1624 - DNA, 16 bp, Artificial sequence
  Synthetic oligonucleotide
ctatccacaccattcc

SEQ ID NO: 1625 - DNA, 16 bp, Artificial sequence
  Synthetic oligonucleotide
ggatcatgggccccta

SEQ ID NO: 1626 - DNA, 16 bp, Artificial sequence
  Synthetic oligonucleotide
gtgaatttgctgggcc

SEQ ID NO: 1627 - DNA, 16 bp, Artificial sequence
  Synthetic oligonucleotide
gtgatgggcccaaggc

SEQ ID NO: 1628 - DNA, 16 bp, Artificial sequence
  Synthetic oligonucleotide
tcctcagtcggcttgc

SEQ ID NO: 1629 - DNA, 16 bp, Artificial sequence
  Synthetic oligonucleotide
cagccttttgccagat

SEQ ID NO: 1630 - DNA, 16 bp, Artificial sequence
  Synthetic oligonucleotide
cctccctaggattacc

SEQ ID NO: 1631 - DNA, 16 bp, Artificial sequence
  Synthetic oligonucleotide
acgccccaatcactca

SEQ ID NO: 1632 - DNA, 16 bp, Artificial sequence
  Synthetic oligonucleotide
gcatgacccattatgt

SEQ ID NO: 1633 - DNA, 16 bp, Artificial sequence
  Synthetic oligonucleotide
tccctccaagagctca

SEQ ID NO: 1634 - DNA, 16 bp, Artificial sequence
  Synthetic oligonucleotide
gatgcctgtggctgac

SEQ ID NO: 1635 - DNA, 16 bp, Artificial sequence
  Synthetic oligonucleotide
ggctagcatgttgcct

SEQ ID NO: 1636 - DNA, 16 bp, Artificial sequence
  Synthetic oligonucleotide
taacccactaggctgg

SEQ ID NO: 1637 - DNA, 16 bp, Artificial sequence
  Synthetic oligonucleotide
tggcccaaaactaatc

SEQ ID NO: 1638 - DNA, 16 bp, Artificial sequence
  Synthetic oligonucleotide
ggagcagtctggcacc

SEQ ID NO: 1639 - DNA, 16 bp, Artificial sequence
  Synthetic oligonucleotide
tattctgtgggacaag

SEQ ID NO: 1640 - DNA, 16 bp, Artificial sequence
  Synthetic oligonucleotide
gtgtctagttccagcc

SEQ ID NO: 1641 - DNA, 16 bp, Artificial sequence
  Synthetic oligonucleotide
tactatcatgtagcgc

SEQ ID NO: 1642 - DNA, 16 bp, Artificial sequence
  Synthetic oligonucleotide
tgcccttgtagtgaga

SEQ ID NO: 1643 - DNA, 16 bp, Artificial sequence
  Synthetic oligonucleotide
tccccaacctacaagc

SEQ ID NO: 1644 - DNA, 16 bp, Artificial sequence
  Synthetic oligonucleotide
gctctaggcatatgaa

SEQ ID NO: 1645 - DNA, 16 bp, Artificial sequence
  Synthetic oligonucleotide
tacctcccttgtaggg

SEQ ID NO: 1646 - DNA, 16 bp, Artificial sequence
  Synthetic oligonucleotide
ggttcccttgcagaga

SEQ ID NO: 1647 - DNA, 16 bp, Artificial sequence
  Synthetic oligonucleotide
gtgccctcttcatgcc

SEQ ID NO: 1648 - DNA, 16 bp, Artificial sequence
  Synthetic oligonucleotide
cctgtgtgcaactggc

SEQ ID NO: 1649 - DNA, 16 bp, Artificial sequence
  Synthetic oligonucleotide
ctgagtcatttgcctg

SEQ ID NO: 1650 - DNA, 16 bp, Artificial sequence
  Synthetic oligonucleotide
ggccttagtaggccag

SEQ ID NO: 1651 - DNA, 16 bp, Artificial sequence
  Synthetic oligonucleotide
gtccttgcagtcaacc

SEQ ID NO: 1652 - DNA, 16 bp, Artificial sequence
  Synthetic oligonucleotide
gctgggccaagtccat

SEQ ID NO: 1653 - DNA, 16 bp, Artificial sequence
  Synthetic oligonucleotide
tagggcactttttgcc

SEQ ID NO: 1654 - DNA, 16 bp, Artificial sequence
  Synthetic oligonucleotide
gctgaggtccctctct

SEQ ID NO: 1655 - DNA, 16 bp, Artificial sequence
  Synthetic oligonucleotide
ctttggtcccattgcc

SEQ ID NO: 1656 - DNA, 16 bp, Artificial sequence
  Synthetic oligonucleotide
ggaacatgccaagggc

SEQ ID NO: 1657 - DNA, 16 bp, Artificial sequence
  Synthetic oligonucleotide
aggtggtctcccttca

SEQ ID NO: 1658 - DNA, 16 bp, Artificial sequence
  Synthetic oligonucleotide
tcccaaagctcccctc

SEQ ID NO: 1659 - DNA, 16 bp, Artificial sequence
  Synthetic oligonucleotide
cctggcctagcaagct

SEQ ID NO: 1660 - DNA, 16 bp, Artificial sequence
  Synthetic oligonucleotide
tcttagccctgggcta

SEQ ID NO: 1661 - DNA, 16 bp, Artificial sequence
  Synthetic oligonucleotide
gacttggactgggctc

SEQ ID NO: 1662 - DNA, 16 bp, Artificial sequence
  Synthetic oligonucleotide
ggcctaggatctagga

SEQ ID NO: 1663 - DNA, 16 bp, Artificial sequence
  Synthetic oligonucleotide
gtcaggctagagggac

SEQ ID NO: 1664 - DNA, 16 bp, Artificial sequence
  Synthetic oligonucleotide
ggaagttctcccagcc

SEQ ID NO: 1665 - DNA, 16 bp, Artificial sequence
  Synthetic oligonucleotide
cctgactgatgtacac

SEQ ID NO: 1666 - DNA, 16 bp, Artificial sequence
  Synthetic oligonucleotide
ctctggcctagcctat

SEQ ID NO: 1667 - DNA, 16 bp, Artificial sequence
  Synthetic oligonucleotide
ggctgctgtcagatgc

SEQ ID NO: 1668 - DNA, 16 bp, Artificial sequence
  Synthetic oligonucleotide
tctcaggtgtaggcag

SEQ ID NO: 1669 - DNA, 16 bp, Artificial sequence
  Synthetic oligonucleotide
ggtcactgagactggg

SEQ ID NO: 1670 - DNA, 16 bp, Artificial sequence
  Synthetic oligonucleotide
acccactagcagctag

SEQ ID NO: 1671 - DNA, 16 bp, Artificial sequence
  Synthetic oligonucleotide
cggatgaggcagttag

SEQ ID NO: 1672 - DNA, 16 bp, Artificial sequence
  Synthetic oligonucleotide
tggtaggccctctggc

SEQ ID NO: 1673 - DNA, 16 bp, Artificial sequence
  Synthetic oligonucleotide
gtcacaaggtgggtgc

SEQ ID NO: 1674 - DNA, 16 bp, Artificial sequence
  Synthetic oligonucleotide
gtcttgccctcacgga

SEQ ID NO: 1675 - DNA, 16 bp, Artificial sequence
  Synthetic oligonucleotide
gcagtctgtggactta

SEQ ID NO: 1676 - DNA, 16 bp, Artificial sequence
  Synthetic oligonucleotide
tgctctctggtcacac

SEQ ID NO: 1677 - DNA, 16 bp, Artificial sequence
  Synthetic oligonucleotide
tatcccccagagccat

SEQ ID NO: 1678 - DNA, 16 bp, Artificial sequence
  Synthetic oligonucleotide
aaggtgagagggcact

SEQ ID NO: 1679 - DNA, 16 bp, Artificial sequence
  Synthetic oligonucleotide
gttttaacctcaccct

SEQ ID NO: 1680 - DNA, 16 bp, Artificial sequence
  Synthetic oligonucleotide
ccttccactgaccttc

SEQ ID NO: 1681 - DNA, 16 bp, Artificial sequence
  Synthetic oligonucleotide
gacactagcctaagcc

SEQ ID NO: 1682 - DNA, 16 bp, Artificial sequence
  Synthetic oligonucleotide
ggttagccctcagcct

SEQ ID NO: 1683 - DNA, 16 bp, Artificial sequence
  Synthetic oligonucleotide
tatgaaggttggacca

SEQ ID NO: 1684 - DNA, 16 bp, Artificial sequence
  Synthetic oligonucleotide
caaccagctcacctga

SEQ ID NO: 1685 - DNA, 16 bp, Artificial sequence
  Synthetic oligonucleotide
gggctccaaggctctc

SEQ ID NO: 1686 - DNA, 16 bp, Artificial sequence
  Synthetic oligonucleotide
agctgttacatgccaa

SEQ ID NO: 1687 - DNA, 16 bp, Artificial sequence
  Synthetic oligonucleotide
ggcccagaggttatag

SEQ ID NO: 1688 - DNA, 16 bp, Artificial sequence
  Synthetic oligonucleotide
gtccttagacccctca

SEQ ID NO: 1689 - DNA, 16 bp, Artificial sequence
  Synthetic oligonucleotide
gccctggctagagaca

SEQ ID NO: 1690 - DNA, 16 bp, Artificial sequence
  Synthetic oligonucleotide
catccagcagctggac

SEQ ID NO: 1691 - DNA, 16 bp, Artificial sequence
  Synthetic oligonucleotide
gactgaggtcatcaca

SEQ ID NO: 1692 - DNA, 16 bp, Artificial sequence
  Synthetic oligonucleotide
ggccaggcacatcatg

SEQ ID NO: 1693 - DNA, 16 bp, Artificial sequence
  Synthetic oligonucleotide
ggagctcattgagcca

SEQ ID NO: 1694 - DNA, 16 bp, Artificial sequence
  Synthetic oligonucleotide
gtgcccattgctgtgt

SEQ ID NO: 1695 - DNA, 16 bp, Artificial sequence
  Synthetic oligonucleotide
ccaagtgtggcttcag

SEQ ID NO: 1696 - DNA, 16 bp, Artificial sequence
  Synthetic oligonucleotide
ccaccctttatacgca

SEQ ID NO: 1697 - DNA, 16 bp, Artificial sequence
  Synthetic oligonucleotide
cagtaaccccaaggga

SEQ ID NO: 1698 - DNA, 16 bp, Artificial sequence
  Synthetic oligonucleotide
ccccaccttatatggg

SEQ ID NO: 1699 - DNA, 16 bp, Artificial sequence
  Synthetic oligonucleotide
aggccctttttacatg

SEQ ID NO: 1700 - DNA, 16 bp, Artificial sequence
  Synthetic oligonucleotide
tcaataagtccctagg

SEQ ID NO: 1701 - DNA, 16 bp, Artificial sequence
  Synthetic oligonucleotide
ggcattgagtgactgc

SEQ ID NO: 1702 - DNA, 16 bp, Artificial sequence
  Synthetic oligonucleotide
ataatgccttctcagc

SEQ ID NO: 1703 - DNA, 16 bp, Artificial sequence
  Synthetic oligonucleotide
gtgaggcatttagccc

SEQ ID NO: 1704 - DNA, 16 bp, Artificial sequence
  Synthetic oligonucleotide
gctcttgtgttgggta

SEQ ID NO: 1705 - DNA, 16 bp, Artificial sequence
  Synthetic oligonucleotide
tgtgcaggaggtctca

SEQ ID NO: 1706 - DNA, 16 bp, Artificial sequence
  Synthetic oligonucleotide
tggagagtcttgtctc

SEQ ID NO: 1707 - DNA, 16 bp, Artificial sequence
  Synthetic oligonucleotide
gtgacccacccaagag

SEQ ID NO: 1708 - DNA, 16 bp, Artificial sequence
  Synthetic oligonucleotide
gttgtagctagtgttc

SEQ ID NO: 1709 - DNA, 16 bp, Artificial sequence
  Synthetic oligonucleotide
gccttagtttgtgcca

SEQ ID NO: 1710 - DNA, 16 bp, Artificial sequence
  Synthetic oligonucleotide
gccccagctgagaatt

SEQ ID NO: 1711 - DNA, 16 bp, Artificial sequence
  Synthetic oligonucleotide
acaacaatccagggtg

SEQ ID NO: 1712 - DNA, 16 bp, Artificial sequence
  Synthetic oligonucleotide
ctcccctggaagtcac

SEQ ID NO: 1713 - DNA, 16 bp, Artificial sequence
  Synthetic oligonucleotide
gccctcatggctcaag

SEQ ID NO: 1714 - DNA, 16 bp, Artificial sequence
  Synthetic oligonucleotide
tcagcagatagggagc

SEQ ID NO: 1715 - DNA, 16 bp, Artificial sequence
  Synthetic oligonucleotide
gaatgcggtgatcagg

SEQ ID NO: 1716 - DNA, 16 bp, Artificial sequence
  Synthetic oligonucleotide
ctgagagaattggccc

SEQ ID NO: 1717 - DNA, 16 bp, Artificial sequence
  Synthetic oligonucleotide
aggcacattgttacca

SEQ ID NO: 1718 - DNA, 16 bp, Artificial sequence
  Synthetic oligonucleotide
gggaggcactagagaa

SEQ ID NO: 1719 - DNA, 16 bp, Artificial sequence
  Synthetic oligonucleotide
tacagtaacacatccc

SEQ ID NO: 1720 - DNA, 16 bp, Artificial sequence
  Synthetic oligonucleotide
gaagctcagcctgatc

SEQ ID NO: 1721 - DNA, 16 bp, Artificial sequence
  Synthetic oligonucleotide
cttgcctgacaaccta

SEQ ID NO: 1722 - DNA, 16 bp, Artificial sequence
  Synthetic oligonucleotide
gcctacctgcttttgc

SEQ ID NO: 1723 - DNA, 16 bp, Artificial sequence
  Synthetic oligonucleotide
tttcccaaccacttag

SEQ ID NO: 1724 - DNA, 16 bp, Artificial sequence
  Synthetic oligonucleotide
tctcctatttcagtta

SEQ ID NO: 1725 - DNA, 16 bp, Artificial sequence
  Synthetic oligonucleotide
gggtgatggatgaact

SEQ ID NO: 1726 - DNA, 16 bp, Artificial sequence
  Synthetic oligonucleotide
acactgctggtagtga

SEQ ID NO: 1727 - DNA, 16 bp, Artificial sequence
  Synthetic oligonucleotide
acccaactagcctgtc

SEQ ID NO: 1728 - DNA, 16 bp, Artificial sequence
  Synthetic oligonucleotide
gagacctgctgcctga

SEQ ID NO: 1729 - DNA, 16 bp, Artificial sequence
  Synthetic oligonucleotide
acatctcttgggaggt

SEQ ID NO: 1730 - DNA, 16 bp, Artificial sequence
  Synthetic oligonucleotide
acatagtacccctcca

SEQ ID NO: 1731 - DNA, 16 bp, Artificial sequence
  Synthetic oligonucleotide
ctctcaagtacctgcc

SEQ ID NO: 1732 - DNA, 16 bp, Artificial sequence
  Synthetic oligonucleotide
tttgtacccaaccccc

SEQ ID NO: 1733 - DNA, 16 bp, Artificial sequence
  Synthetic oligonucleotide
aggcccacataaatgc

SEQ ID NO: 1734 - DNA, 16 bp, Artificial sequence
  Synthetic oligonucleotide
gagcatcccctacact

SEQ ID NO: 1735 - DNA, 16 bp, Artificial sequence
  Synthetic oligonucleotide
gctgggcctttagctg

SEQ ID NO: 1736 - DNA, 16 bp, Artificial sequence
  Synthetic oligonucleotide
ttggtcaattgggcag

SEQ ID NO: 1737 - DNA, 16 bp, Artificial sequence
  Synthetic oligonucleotide
gtctcatgaggcctat

SEQ ID NO: 1738 - DNA, 16 bp, Artificial sequence
  Synthetic oligonucleotide
ggaggtgggatcccac

SEQ ID NO: 1739 - DNA, 16 bp, Artificial sequence
  Synthetic oligonucleotide
gcccactacctagcac

SEQ ID NO: 1740 - DNA, 16 bp, Artificial sequence
  Synthetic oligonucleotide
cccagctggctggtcg

SEQ ID NO: 1741 - DNA, 16 bp, Artificial sequence
  Synthetic oligonucleotide
gcaccaggtctcctgt

SEQ ID NO: 1742 - DNA, 16 bp, Artificial sequence
  Synthetic oligonucleotide
gtctagaagcctaggg

SEQ ID NO: 1743 - DNA, 16 bp, Artificial sequence
  Synthetic oligonucleotide
gccgggtgttggtgca

SEQ ID NO: 1744 - DNA, 16 bp, Artificial sequence
  Synthetic oligonucleotide
ttggtgcctgtgttgc

SEQ ID NO: 1745 - DNA, 16 bp, Artificial sequence
  Synthetic oligonucleotide
tgcttctgatccctac

SEQ ID NO: 1746 - DNA, 16 bp, Artificial sequence
  Synthetic oligonucleotide
gttcccaggaggctta

SEQ ID NO: 1747 - DNA, 16 bp, Artificial sequence
  Synthetic oligonucleotide
aggcccctagagtcta

SEQ ID NO: 1748 - DNA, 16 bp, Artificial sequence
  Synthetic oligonucleotide
tggtgtgcccagactt

SEQ ID NO: 1749 - DNA, 16 bp, Artificial sequence
  Synthetic oligonucleotide
gatggctaacccactg

SEQ ID NO: 1750 - DNA, 16 bp, Artificial sequence
  Synthetic oligonucleotide
cccccaaaagttgccc

SEQ ID NO: 1751 - DNA, 16 bp, Artificial sequence
  Synthetic oligonucleotide
tagggtgttccagatc

SEQ ID NO: 1752 - DNA, 16 bp, Artificial sequence
  Synthetic oligonucleotide
gtaccatgaagctctg

SEQ ID NO: 1753 - DNA, 16 bp, Artificial sequence
  Synthetic oligonucleotide
cttggacttggaccat

SEQ ID NO: 1754 - DNA, 16 bp, Artificial sequence
  Synthetic oligonucleotide
gtgcatagggcctgtc

SEQ ID NO: 1755 - DNA, 16 bp, Artificial sequence
  Synthetic oligonucleotide
cctcacctgaacaccc

SEQ ID NO: 1756 - DNA, 16 bp, Artificial sequence
  Synthetic oligonucleotide
atgcctccccgcaact

SEQ ID NO: 1757 - DNA, 16 bp, Artificial sequence
  Synthetic oligonucleotide
ttgtgcttgggtgtac

SEQ ID NO: 1758 - DNA, 16 bp, Artificial sequence
  Synthetic oligonucleotide
aggcttcatgtgaggt

SEQ ID NO: 1759 - DNA, 16 bp, Artificial sequence
  Synthetic oligonucleotide
tgtaaaaggtcctccc

SEQ ID NO: 1760 - DNA, 16 bp, Artificial sequence
  Synthetic oligonucleotide
gacctgtgcagcaggt

SEQ ID NO: 1761 - DNA, 16 bp, Artificial sequence
  Synthetic oligonucleotide
tcctcttggagatcca

SEQ ID NO: 1762 - DNA, 16 bp, Artificial sequence
  Synthetic oligonucleotide
aggtcataggactgct

SEQ ID NO: 1763 - DNA, 16 bp, Artificial sequence
  Synthetic oligonucleotide
gaaggtcagactaggg

SEQ ID NO: 1764 - DNA, 16 bp, Artificial sequence
  Synthetic oligonucleotide
tctgtagactgcccag

SEQ ID NO: 1765 - DNA, 16 bp, Artificial sequence
  Synthetic oligonucleotide
gtccctctattcccct

SEQ ID NO: 1766 - DNA, 16 bp, Artificial sequence
  Synthetic oligonucleotide
aattgccatgctccca

SEQ ID NO: 1767 - DNA, 16 bp, Artificial sequence
  Synthetic oligonucleotide
gatgaccttcctccaa

SEQ ID NO: 1768 - DNA, 16 bp, Artificial sequence
  Synthetic oligonucleotide
gtttccagtagcacct

SEQ ID NO: 1769 - DNA, 16 bp, Artificial sequence
  Synthetic oligonucleotide
ggccttgagctgatgg

SEQ ID NO: 1770 - DNA, 16 bp, Artificial sequence
  Synthetic oligonucleotide
tatccctaatcaggct

SEQ ID NO: 1771 - DNA, 16 bp, Artificial sequence
  Synthetic oligonucleotide
ggtgtccacatcccgg

SEQ ID NO: 1772 - DNA, 16 bp, Artificial sequence
  Synthetic oligonucleotide
agctggacaggccata

SEQ ID NO: 1773 - DNA, 16 bp, Artificial sequence
  Synthetic oligonucleotide
ggtaatcacccagaga

SEQ ID NO: 1774 - DNA, 16 bp, Artificial sequence
  Synthetic oligonucleotide
gcgctaagtctgctgt

SEQ ID NO: 1775 - DNA, 16 bp, Artificial sequence
  Synthetic oligonucleotide
cctcaaatcttgccca

SEQ ID NO: 1776 - DNA, 16 bp, Artificial sequence
  Synthetic oligonucleotide
atccagacctggcaga

SEQ ID NO: 1777 - DNA, 16 bp, Artificial sequence
  Synthetic oligonucleotide
atccctgctcaagtgc

SEQ ID NO: 1778 - DNA, 16 bp, Artificial sequence
  Synthetic oligonucleotide
caggcactccttggaa

SEQ ID NO: 1779 - DNA, 16 bp, Artificial sequence
  Synthetic oligonucleotide
agctgaggtatccctc

SEQ ID NO: 1780 - DNA, 16 bp, Artificial sequence
  Synthetic oligonucleotide
gggcccagcaagtctt

SEQ ID NO: 1781 - DNA, 16 bp, Artificial sequence
  Synthetic oligonucleotide
gttttgtcagtgtgca

SEQ ID NO: 1782 - DNA, 16 bp, Artificial sequence
  Synthetic oligonucleotide
gtgacctgctgaactc

SEQ ID NO: 1783 - DNA, 16 bp, Artificial sequence
  Synthetic oligonucleotide
ggctgaactgtgcacc

SEQ ID NO: 1784 - DNA, 16 bp, Artificial sequence
  Synthetic oligonucleotide
gggtggtcccactcct

SEQ ID NO: 1785 - DNA, 16 bp, Artificial sequence
  Synthetic oligonucleotide
gaggaatcctgggccc

SEQ ID NO: 1786 - DNA, 16 bp, Artificial sequence
  Synthetic oligonucleotide
atgacaagctaggtgc

SEQ ID NO: 1787 - DNA, 16 bp, Artificial sequence
  Synthetic oligonucleotide
ttgccagacagggcac

SEQ ID NO: 1788 - DNA, 16 bp, Artificial sequence
  Synthetic oligonucleotide
agacccctcccactat

SEQ ID NO: 1789 - DNA, 16 bp, Artificial sequence
  Synthetic oligonucleotide
ggtgctgggtgaccgg

SEQ ID NO: 1790 - DNA, 16 bp, Artificial sequence
  Synthetic oligonucleotide
ggccaaacggtgccct

SEQ ID NO: 1791 - DNA, 16 bp, Artificial sequence
  Synthetic oligonucleotide
tgggtgaatagcaacc

SEQ ID NO: 1792 - DNA, 16 bp, Artificial sequence
  Synthetic oligonucleotide
gcccccaaggaagtga

SEQ ID NO: 1793 - DNA, 16 bp, Artificial sequence
  Synthetic oligonucleotide
caggcttcatgtgtgg

SEQ ID NO: 1794 - DNA, 16 bp, Artificial sequence
  Synthetic oligonucleotide
ctgtcagtgctttggt

SEQ ID NO: 1795 - DNA, 16 bp, Artificial sequence
  Synthetic oligonucleotide
gagtaccctggcaggt

SEQ ID NO: 1796 - DNA, 16 bp, Artificial sequence
  Synthetic oligonucleotide
tagctagcacctgggt

SEQ ID NO: 1797 - DNA, 16 bp, Artificial sequence
  Synthetic oligonucleotide
ggcaaacctttgagcc

SEQ ID NO: 1798 - DNA, 16 bp, Artificial sequence
  Synthetic oligonucleotide
gctatcattggagcag

SEQ ID NO: 1799 - DNA, 16 bp, Artificial sequence
  Synthetic oligonucleotide
cctctgagtactccct

SEQ ID NO: 1800 - DNA, 16 bp, Artificial sequence
  Synthetic oligonucleotide
agctgaaggcaaccag

SEQ ID NO: 1801 - DNA, 16 bp, Artificial sequence
  Synthetic oligonucleotide
gggcagttttccatag

SEQ ID NO: 1802 - DNA, 16 bp, Artificial sequence
  Synthetic oligonucleotide
ggtcctacctctgaca

SEQ ID NO: 1803 - DNA, 16 bp, Artificial sequence
  Synthetic oligonucleotide
ggctgccttagggtgg

SEQ ID NO: 1804 - DNA, 16 bp, Artificial sequence
  Synthetic oligonucleotide
cgcacctcccccacta

SEQ ID NO: 1805 - DNA, 16 bp, Artificial sequence
  Synthetic oligonucleotide
gcttattggtccatgg

SEQ ID NO: 1806 - DNA, 16 bp, Artificial sequence
  Synthetic oligonucleotide
aaccgcagagccccca

SEQ ID NO: 1807 - DNA, 16 bp, Artificial sequence
  Synthetic oligonucleotide
gggcttgttctgccaa

SEQ ID NO: 1808 - DNA, 16 bp, Artificial sequence
  Synthetic oligonucleotide
gggacctgcgctgact

SEQ ID NO: 1809 - DNA, 16 bp, Artificial sequence
  Synthetic oligonucleotide
ctttcacctggtgact

SEQ ID NO: 1810 - DNA, 16 bp, Artificial sequence
  Synthetic oligonucleotide
agcttgagggagtata

SEQ ID NO: 1811 - DNA, 16 bp, Artificial sequence
  Synthetic oligonucleotide
gcctgctcaattgagg

SEQ ID NO: 1812 - DNA, 16 bp, Artificial sequence
  Synthetic oligonucleotide
atagcagctggctgcc

SEQ ID NO: 1813 - DNA, 16 bp, Artificial sequence
  Synthetic oligonucleotide
aaaagcttggcacccc

SEQ ID NO: 1814 - DNA, 16 bp, Artificial sequence
  Synthetic oligonucleotide
cctggcaagaagggcc

SEQ ID NO: 1815 - DNA, 16 bp, Artificial sequence
  Synthetic oligonucleotide
ttagcccatctatccc

SEQ ID NO: 1816 - DNA, 16 bp, Artificial sequence
  Synthetic oligonucleotide
gtggtctccctgtgcc

SEQ ID NO: 1817 - DNA, 16 bp, Artificial sequence
  Synthetic oligonucleotide
agccctctctggcaaa

SEQ ID NO: 1818 - DNA, 16 bp, Artificial sequence
  Synthetic oligonucleotide
ttactgtggcccgagt

SEQ ID NO: 1819 - DNA, 16 bp, Artificial sequence
  Synthetic oligonucleotide
gtagactcctagggtc

SEQ ID NO: 1820 - DNA, 16 bp, Artificial sequence
  Synthetic oligonucleotide
cctccagttagtgtgc

SEQ ID NO: 1821 - DNA, 16 bp, Artificial sequence
  Synthetic oligonucleotide
gtgggtggccaacagg

SEQ ID NO: 1822 - DNA, 16 bp, Artificial sequence
  Synthetic oligonucleotide
gggattccctggtagc

SEQ ID NO: 1823 - DNA, 16 bp, Artificial sequence
  Synthetic oligonucleotide
gtgagaccggcctttg

SEQ ID NO: 1824 - DNA, 16 bp, Artificial sequence
  Synthetic oligonucleotide
actggcacccacttgg

SEQ ID NO: 1825 - DNA, 16 bp, Artificial sequence
  Synthetic oligonucleotide
attggcctaatgcccc

SEQ ID NO: 1826 - DNA, 16 bp, Artificial sequence
  Synthetic oligonucleotide
aggctatacattccag

SEQ ID NO: 1827 - DNA, 16 bp, Artificial sequence
  Synthetic oligonucleotide
ggtggcagctaggtgg

SEQ ID NO: 1828 - DNA, 16 bp, Artificial sequence
  Synthetic oligonucleotide
tccacagttggcactg

SEQ ID NO: 1829 - DNA, 16 bp, Artificial sequence
  Synthetic oligonucleotide
tgggccttagattgta

SEQ ID NO: 1830 - DNA, 16 bp, Artificial sequence
  Synthetic oligonucleotide
tgtcttcctggtggcc

SEQ ID NO: 1831 - DNA, 16 bp, Artificial sequence
  Synthetic oligonucleotide
cccgcctctccagcaa

SEQ ID NO: 1832 - DNA, 16 bp, Artificial sequence
  Synthetic oligonucleotide
gcagcagccaataagt

SEQ ID NO: 1833 - DNA, 16 bp, Artificial sequence
  Synthetic oligonucleotide
ttgtatcctggcccct

SEQ ID NO: 1834 - DNA, 16 bp, Artificial sequence
  Synthetic oligonucleotide
gcctcatgggccttac

SEQ ID NO: 1835 - DNA, 16 bp, Artificial sequence
  Synthetic oligonucleotide
ggatgccagtcttggc

SEQ ID NO: 1836 - DNA, 16 bp, Artificial sequence
  Synthetic oligonucleotide
ctgctctcagtacctc

SEQ ID NO: 1837 - DNA, 16 bp, Artificial sequence
  Synthetic oligonucleotide
acccaagaagtcacct

SEQ ID NO: 1838 - DNA, 16 bp, Artificial sequence
  Synthetic oligonucleotide
gcctcaagccctaccc

SEQ ID NO: 1839 - DNA, 16 bp, Artificial sequence
  Synthetic oligonucleotide
agctccagcctataga

SEQ ID NO: 1840 - DNA, 16 bp, Artificial sequence
  Synthetic oligonucleotide
ggtccacatggcccta

SEQ ID NO: 1841 - DNA, 16 bp, Artificial sequence
  Synthetic oligonucleotide
caggcccaggattgtc

SEQ ID NO: 1842 - DNA, 16 bp, Artificial sequence
  Synthetic oligonucleotide
gggcctgctttgcagc

SEQ ID NO: 1843 - DNA, 16 bp, Artificial sequence
  Synthetic oligonucleotide
actcctctctttaggc

SEQ ID NO: 1844 - DNA, 16 bp, Artificial sequence
  Synthetic oligonucleotide
ctgggtaacagtcctc

SEQ ID NO: 1845 - DNA, 16 bp, Artificial sequence
  Synthetic oligonucleotide
actgtatggtttccac

SEQ ID NO: 1846 - DNA, 16 bp, Artificial sequence
  Synthetic oligonucleotide
gccaaagatagctctt

SEQ ID NO: 1847 - DNA, 16 bp, Artificial sequence
  Synthetic oligonucleotide
ggcattggaagttggt

SEQ ID NO: 1848 - DNA, 16 bp, Artificial sequence
  Synthetic oligonucleotide
cccttcctgaccttac

SEQ ID NO: 1849 - DNA, 16 bp, Artificial sequence
  Synthetic oligonucleotide
ttaccctctattcacc

SEQ ID NO: 1850 - DNA, 16 bp, Artificial sequence
  Synthetic oligonucleotide
ggcaccccaggccggg

SEQ ID NO: 1851 - DNA, 16 bp, Artificial sequence
  Synthetic oligonucleotide
cagcagctagttcccc

SEQ ID NO: 1852 - DNA, 16 bp, Artificial sequence
  Synthetic oligonucleotide
gtgggcactagtgtgt

SEQ ID NO: 1853 - DNA, 16 bp, Artificial sequence
  Synthetic oligonucleotide
tgcccttgtcagggca

SEQ ID NO: 1854 - DNA, 16 bp, Artificial sequence
  Synthetic oligonucleotide
gcagataggctcagca

SEQ ID NO: 1855 - DNA, 16 bp, Artificial sequence
  Synthetic oligonucleotide
ccctagcccttagcac

SEQ ID NO: 1856 - DNA, 16 bp, Artificial sequence
  Synthetic oligonucleotide
actggaatggccctct

SEQ ID NO: 1857 - DNA, 16 bp, Artificial sequence
  Synthetic oligonucleotide
tttgctcatgctcaca

SEQ ID NO: 1858 - DNA, 16 bp, Artificial sequence
  Synthetic oligonucleotide
gcctttgtgtgtcact

SEQ ID NO: 1859 - DNA, 16 bp, Artificial sequence
  Synthetic oligonucleotide
tatgtggtagcatgtc

SEQ ID NO: 1860 - DNA, 16 bp, Artificial sequence
  Synthetic oligonucleotide
ccccaggaagttggcc

SEQ ID NO: 1861 - DNA, 16 bp, Artificial sequence
  Synthetic oligonucleotide
tagctgtcaaggccct

SEQ ID NO: 1862 - DNA, 16 bp, Artificial sequence
  Synthetic oligonucleotide
cctagtcagccactag

SEQ ID NO: 1863 - DNA, 16 bp, Artificial sequence
  Synthetic oligonucleotide
agactccccatcagcc

SEQ ID NO: 1864 - DNA, 16 bp, Artificial sequence
  Synthetic oligonucleotide
gtgaagggccttcatc

SEQ ID NO: 1865 - DNA, 16 bp, Artificial sequence
  Synthetic oligonucleotide
ggttgagagtccaatg

SEQ ID NO: 1866 - DNA, 16 bp, Artificial sequence
  Synthetic oligonucleotide
cagctaattccctcat

SEQ ID NO: 1867 - DNA, 16 bp, Artificial sequence
  Synthetic oligonucleotide
ttgtgtctcaacccac

SEQ ID NO: 1868 - DNA, 16 bp, Artificial sequence
  Synthetic oligonucleotide
ggctatgctgcatgct

SEQ ID NO: 1869 - DNA, 16 bp, Artificial sequence
  Synthetic oligonucleotide
ccccatacccagtgga

SEQ ID NO: 1870 - DNA, 16 bp, Artificial sequence
  Synthetic oligonucleotide
ggtggttttcctccct

SEQ ID NO: 1871 - DNA, 16 bp, Artificial sequence
  Synthetic oligonucleotide
gagcctgcccaacttt

SEQ ID NO: 1872 - DNA, 16 bp, Artificial sequence
  Synthetic oligonucleotide
tgatgcccaagagtga

SEQ ID NO: 1873 - DNA, 16 bp, Artificial sequence
  Synthetic oligonucleotide
ttccctctgcgaacat

SEQ ID NO: 1874 - DNA, 16 bp, Artificial sequence
  Synthetic oligonucleotide
gttccatctcaatcca

SEQ ID NO: 1875 - DNA, 16 bp, Artificial sequence
  Synthetic oligonucleotide
acggccactccactgg

SEQ ID NO: 1876 - DNA, 16 bp, Artificial sequence
  Synthetic oligonucleotide
tggaagtggttccaga

SEQ ID NO: 1877 - DNA, 16 bp, Artificial sequence
  Synthetic oligonucleotide
ttgccccagaccaaca

SEQ ID NO: 1878 - DNA, 16 bp, Artificial sequence
  Synthetic oligonucleotide
gaggttgtggaggtgc

SEQ ID NO: 1879 - DNA, 16 bp, Artificial sequence
  Synthetic oligonucleotide
gagttgctgtgtgtga

SEQ ID NO: 1880 - DNA, 16 bp, Artificial sequence
  Synthetic oligonucleotide
catgtcagaggtgtcc

SEQ ID NO: 1881 - DNA, 16 bp, Artificial sequence
  Synthetic oligonucleotide
aggtaaggatcatggc

SEQ ID NO: 1882 - DNA, 16 bp, Artificial sequence
  Synthetic oligonucleotide
gttcagttgcatcacg

SEQ ID NO: 1883 - DNA, 16 bp, Artificial sequence
  Synthetic oligonucleotide
gcccagctagccaccc

SEQ ID NO: 1884 - DNA, 16 bp, Artificial sequence
  Synthetic oligonucleotide
ccttagcagccaggcc

SEQ ID NO: 1885 - DNA, 16 bp, Artificial sequence
  Synthetic oligonucleotide
gcacttagggttttgc

SEQ ID NO: 1886 - DNA, 16 bp, Artificial sequence
  Synthetic oligonucleotide
gttgaactttccctac

SEQ ID NO: 1887 - DNA, 16 bp, Artificial sequence
  Synthetic oligonucleotide
tgactccttgagacag

SEQ ID NO: 1888 - DNA, 16 bp, Artificial sequence
  Synthetic oligonucleotide
tgcgctggcttagcaa

SEQ ID NO: 1889 - DNA, 16 bp, Artificial sequence
  Synthetic oligonucleotide
ggcctaacatcagcag

SEQ ID NO: 1890 - DNA, 16 bp, Artificial sequence
  Synthetic oligonucleotide
actcctcccagttagc

SEQ ID NO: 1891 - DNA, 16 bp, Artificial sequence
  Synthetic oligonucleotide
accagtggccaatgtc

SEQ ID NO: 1892 - DNA, 16 bp, Artificial sequence
  Synthetic oligonucleotide
gcctagacacagtagg

SEQ ID NO: 1893 - DNA, 16 bp, Artificial sequence
  Synthetic oligonucleotide
tattctccccctaggg

SEQ ID NO: 1894 - DNA, 16 bp, Artificial sequence
  Synthetic oligonucleotide
gacggccttgggcaca

SEQ ID NO: 1895 - DNA, 16 bp, Artificial sequence
  Synthetic oligonucleotide
gcaggctgtattagca

SEQ ID NO: 1896 - DNA, 16 bp, Artificial sequence
  Synthetic oligonucleotide
accccctatcctgcac

SEQ ID NO: 1897 - DNA, 16 bp, Artificial sequence
  Synthetic oligonucleotide
tcctccatacctagag

SEQ ID NO: 1898 - DNA, 16 bp, Artificial sequence
  Synthetic oligonucleotide
gataggtgcccactgt

SEQ ID NO: 1899 - DNA, 16 bp, Artificial sequence
  Synthetic oligonucleotide
gtcagttctggctagg

SEQ ID NO: 1900 - DNA, 16 bp, Artificial sequence
  Synthetic oligonucleotide
gcctgaacttacaagc

SEQ ID NO: 1901 - DNA, 16 bp, Artificial sequence
  Synthetic oligonucleotide
accctgggctgacctt

SEQ ID NO: 1902 - DNA, 16 bp, Artificial sequence
  Synthetic oligonucleotide
ggacctggacaagcaa

SEQ ID NO: 1903 - DNA, 16 bp, Artificial sequence
  Synthetic oligonucleotide
ctccttgcgagagagg

SEQ ID NO: 1904 - DNA, 16 bp, Artificial sequence
  Synthetic oligonucleotide
agagttgacatgggca

SEQ ID NO: 1905 - DNA, 16 bp, Artificial sequence
  Synthetic oligonucleotide
cactaggtccctgacc

SEQ ID NO: 1906 - DNA, 16 bp, Artificial sequence
  Synthetic oligonucleotide
cactctcttgggctgt

SEQ ID NO: 1907 - DNA, 16 bp, Artificial sequence
  Synthetic oligonucleotide
agggacctgcattcca

SEQ ID NO: 1908 - DNA, 16 bp, Artificial sequence
  Synthetic oligonucleotide
ttcaccacccattggg

SEQ ID NO: 1909 - DNA, 16 bp, Artificial sequence
  Synthetic oligonucleotide
atctggtctgagggcc

SEQ ID NO: 1910 - DNA, 16 bp, Artificial sequence
  Synthetic oligonucleotide
gacatgcaattgaccc

SEQ ID NO: 1911 - DNA, 16 bp, Artificial sequence
  Synthetic oligonucleotide
gtgtgcagcagactgt

SEQ ID NO: 1912 - DNA, 16 bp, Artificial sequence
  Synthetic oligonucleotide
gacagtccagctgcaa

SEQ ID NO: 1913 - DNA, 16 bp, Artificial sequence
  Synthetic oligonucleotide
cctgcggcagtgaaga

SEQ ID NO: 1914 - DNA, 16 bp, Artificial sequence
  Synthetic oligonucleotide
ctctgaggataaccct

SEQ ID NO: 1915 - DNA, 16 bp, Artificial sequence
  Synthetic oligonucleotide
gttcccagctccccaa

SEQ ID NO: 1916 - DNA, 16 bp, Artificial sequence
  Synthetic oligonucleotide
tagggtcagtgtccca

SEQ ID NO: 1917 - DNA, 16 bp, Artificial sequence
  Synthetic oligonucleotide
ggcgagcctctcagcc

SEQ ID NO: 1918 - DNA, 16 bp, Artificial sequence
  Synthetic oligonucleotide
gactcatccaggcagt

SEQ ID NO: 1919 - DNA, 16 bp, Artificial sequence
  Synthetic oligonucleotide
tccctcccttaggcac

SEQ ID NO: 1920 - DNA, 16 bp, Artificial sequence
  Synthetic oligonucleotide
gaggagccaggcatat

SEQ ID NO: 1921 - DNA, 16 bp, Artificial sequence
  Synthetic oligonucleotide
caccaacgaagtcccc

SEQ ID NO: 1922 - DNA, 16 bp, Artificial sequence
  Synthetic oligonucleotide
gctggcagtcaccaaa

SEQ ID NO: 1923 - DNA, 16 bp, Artificial sequence
  Synthetic oligonucleotide
gcccacaccattgagc

SEQ ID NO: 1924 - DNA, 16 bp, Artificial sequence
  Synthetic oligonucleotide
agtgagatgccctggt

SEQ ID NO: 1925 - DNA, 16 bp, Artificial sequence
  Synthetic oligonucleotide
cactggcagttagacc

SEQ ID NO: 1926 - DNA, 16 bp, Artificial sequence
  Synthetic oligonucleotide
actctggccactagta

SEQ ID NO: 1927 - DNA, 16 bp, Artificial sequence
  Synthetic oligonucleotide
ggtagggtggccacat

SEQ ID NO: 1928 - DNA, 16 bp, Artificial sequence
  Synthetic oligonucleotide
gagccatgtctaggca

SEQ ID NO: 1929 - DNA, 16 bp, Artificial sequence
  Synthetic oligonucleotide
cagactgaaacccacc

SEQ ID NO: 1930 - DNA, 16 bp, Artificial sequence
  Synthetic oligonucleotide
tatggtccagccacca

SEQ ID NO: 1931 - DNA, 16 bp, Artificial sequence
  Synthetic oligonucleotide
tacctcctctgttggt

SEQ ID NO: 1932 - DNA, 16 bp, Artificial sequence
  Synthetic oligonucleotide
acacctcagtcatgat

SEQ ID NO: 1933 - DNA, 16 bp, Artificial sequence
  Synthetic oligonucleotide
aacaggcttcaagagg

SEQ ID NO: 1934 - DNA, 16 bp, Artificial sequence
  Synthetic oligonucleotide
gtactactggccatgt

SEQ ID NO: 1935 - DNA, 16 bp, Artificial sequence
  Synthetic oligonucleotide
ctgcaggcggttgcta

SEQ ID NO: 1936 - DNA, 16 bp, Artificial sequence
  Synthetic oligonucleotide
gtctgttgccaagagc

SEQ ID NO: 1937 - DNA, 16 bp, Artificial sequence
  Synthetic oligonucleotide
ccctgggtcacttaag

SEQ ID NO: 1938 - DNA, 16 bp, Artificial sequence
  Synthetic oligonucleotide
cctgtccttgcttgca

SEQ ID NO: 1939 - DNA, 16 bp, Artificial sequence
  Synthetic oligonucleotide
gcccagcttatcctaa

SEQ ID NO: 1940 - DNA, 16 bp, Artificial sequence
  Synthetic oligonucleotide
agtagagcctttgcct

SEQ ID NO: 1941 - DNA, 16 bp, Artificial sequence
  Synthetic oligonucleotide
ctgtctcttggcccat

SEQ ID NO: 1942 - DNA, 16 bp, Artificial sequence
  Synthetic oligonucleotide
ggcccaaatcttgagt

SEQ ID NO: 1943 - DNA, 16 bp, Artificial sequence
  Synthetic oligonucleotide
gcttgttacagcacta

SEQ ID NO: 1944 - DNA, 16 bp, Artificial sequence
  Synthetic oligonucleotide
actttggcccagagat

SEQ ID NO: 1945 - DNA, 16 bp, Artificial sequence
  Synthetic oligonucleotide
gcagtcaggtcagctg

SEQ ID NO: 1946 - DNA, 16 bp, Artificial sequence
  Synthetic oligonucleotide
gccttgtcctactacc

SEQ ID NO: 1947 - DNA, 16 bp, Artificial sequence
  Synthetic oligonucleotide
ggctctgctattggcc

SEQ ID NO: 1948 - DNA, 16 bp, Artificial sequence
  Synthetic oligonucleotide
cttatagagccttgcc

SEQ ID NO: 1949 - DNA, 16 bp, Artificial sequence
  Synthetic oligonucleotide
ggaagggcccaaatat

SEQ ID NO: 1950 - DNA, 16 bp, Artificial sequence
  Synthetic oligonucleotide
gatctactcctactgc

SEQ ID NO: 1951 - DNA, 16 bp, Artificial sequence
  Synthetic oligonucleotide
gtcagcctgtgtctga

SEQ ID NO: 1952 - DNA, 16 bp, Artificial sequence
  Synthetic oligonucleotide
agcttcctccttacac

SEQ ID NO: 1953 - DNA, 16 bp, Artificial sequence
  Synthetic oligonucleotide
ctgctaagcccctacc

SEQ ID NO: 1954 - DNA, 16 bp, Artificial sequence
  Synthetic oligonucleotide
agaggtcaggtgcata

SEQ ID NO: 1955 - DNA, 16 bp, Artificial sequence
  Synthetic oligonucleotide
ttcagcctggttggga

SEQ ID NO: 1956 - DNA, 16 bp, Artificial sequence
  Synthetic oligonucleotide
gattgattgagctcct

SEQ ID NO: 1957 - DNA, 16 bp, Artificial sequence
  Synthetic oligonucleotide
atggactccctaggct

SEQ ID NO: 1958 - DNA, 16 bp, Artificial sequence
  Synthetic oligonucleotide
tactcaagggcccctc

SEQ ID NO: 1959 - DNA, 16 bp, Artificial sequence
  Synthetic oligonucleotide
ggcatatgtagcttgc

SEQ ID NO: 1960 - DNA, 16 bp, Artificial sequence
  Synthetic oligonucleotide
gagcttagatctgtgc

SEQ ID NO: 1961 - DNA, 16 bp, Artificial sequence
  Synthetic oligonucleotide
atgctcacggctgtgt

SEQ ID NO: 1962 - DNA, 16 bp, Artificial sequence
  Synthetic oligonucleotide
attgaaaggcccatca

SEQ ID NO: 1963 - DNA, 16 bp, Artificial sequence
  Synthetic oligonucleotide
caacccagtttgccgg

SEQ ID NO: 1964 - DNA, 16 bp, Artificial sequence
  Synthetic oligonucleotide
cagctattccctgttt

SEQ ID NO: 1965 - DNA, 16 bp, Artificial sequence
  Synthetic oligonucleotide
gctgtgtcacacttcc

SEQ ID NO: 1966 - DNA, 16 bp, Artificial sequence
  Synthetic oligonucleotide
gtccaaggatcacagc

SEQ ID NO: 1967 - DNA, 16 bp, Artificial sequence
  Synthetic oligonucleotide
gctaccactagagcct

SEQ ID NO: 1968 - DNA, 16 bp, Artificial sequence
  Synthetic oligonucleotide
gtttcagggcttatgt

SEQ ID NO: 1969 - DNA, 16 bp, Artificial sequence
  Synthetic oligonucleotide
tcccacacctattgaa

SEQ ID NO: 1970 - DNA, 16 bp, Artificial sequence
  Synthetic oligonucleotide
actgactagagagtcc

SEQ ID NO: 1971 - DNA, 16 bp, Artificial sequence
  Synthetic oligonucleotide
tccaaggctgatgtcc

SEQ ID NO: 1972 - DNA, 16 bp, Artificial sequence
  Synthetic oligonucleotide
tcccatggtggacatg

SEQ ID NO: 1973 - DNA, 16 bp, Artificial sequence
  Synthetic oligonucleotide
agtagctggcagaagg

SEQ ID NO: 1974 - DNA, 16 bp, Artificial sequence
  Synthetic oligonucleotide
ctgggagtgactacta

SEQ ID NO: 1975 - DNA, 16 bp, Artificial sequence
  Synthetic oligonucleotide
tggtatagctactggg

SEQ ID NO: 1976 - DNA, 16 bp, Artificial sequence
  Synthetic oligonucleotide
ctgtggtttggcaggt

SEQ ID NO: 1977 - DNA, 16 bp, Artificial sequence
  Synthetic oligonucleotide
gttctcacctgaacta

SEQ ID NO: 1978 - DNA, 16 bp, Artificial sequence
  Synthetic oligonucleotide
ataggctactggcagg

SEQ ID NO: 1979 - DNA, 16 bp, Artificial sequence
  Synthetic oligonucleotide
cccagctagctggagt

SEQ ID NO: 1980 - DNA, 16 bp, Artificial sequence
  Synthetic oligonucleotide
ggctggctctcaaagg

SEQ ID NO: 1981 - DNA, 16 bp, Artificial sequence
  Synthetic oligonucleotide
tggtgatactgtggca

SEQ ID NO: 1982 - DNA, 16 bp, Artificial sequence
  Synthetic oligonucleotide
gctgattttggtgcca

SEQ ID NO: 1983 - DNA, 16 bp, Artificial sequence
  Synthetic oligonucleotide
gctaatcttgcctcga

SEQ ID NO: 1984 - DNA, 16 bp, Artificial sequence
  Synthetic oligonucleotide
cactggtggctttcaa

SEQ ID NO: 1985 - DNA, 16 bp, Artificial sequence
  Synthetic oligonucleotide
gtccccttcttaagca

SEQ ID NO: 1986 - DNA, 16 bp, Artificial sequence
  Synthetic oligonucleotide
gccaggccaactgtgg

SEQ ID NO: 1987 - DNA, 16 bp, Artificial sequence
  Synthetic oligonucleotide
ggcccgttatggtgga

SEQ ID NO: 1988 - DNA, 16 bp, Artificial sequence
  Synthetic oligonucleotide
cctaaagtccaactcc

SEQ ID NO: 1989 - DNA, 16 bp, Artificial sequence
  Synthetic oligonucleotide
ccctatccagccttca

SEQ ID NO: 1990 - DNA, 16 bp, Artificial sequence
  Synthetic oligonucleotide
aagcatggcctctggc

SEQ ID NO: 1991 - DNA, 16 bp, Artificial sequence
  Synthetic oligonucleotide
taccctgcaccctcct

SEQ ID NO: 1992 - DNA, 16 bp, Artificial sequence
  Synthetic oligonucleotide
tccttagtagaatgcc

SEQ ID NO: 1993 - DNA, 16 bp, Artificial sequence
  Synthetic oligonucleotide
ttagccctgggagcac

SEQ ID NO: 1994 - DNA, 16 bp, Artificial sequence
  Synthetic oligonucleotide
gctgggtcaggtagcg

SEQ ID NO: 1995 - DNA, 16 bp, Artificial sequence
  Synthetic oligonucleotide
gggaggctctcaatct

SEQ ID NO: 1996 - DNA, 16 bp, Artificial sequence
  Synthetic oligonucleotide
gtaagtgcagaatgcc

SEQ ID NO: 1997 - DNA, 16 bp, Artificial sequence
  Synthetic oligonucleotide
tgccgaggcaggcacc

SEQ ID NO: 1998 - DNA, 16 bp, Artificial sequence
  Synthetic oligonucleotide
tccgtgtctaggaggt

SEQ ID NO: 1999 - DNA, 16 bp, Artificial sequence
  Synthetic oligonucleotide
gtctccctgcattgga

SEQ ID NO: 2000 - DNA, 16 bp, Artificial sequence
  Synthetic oligonucleotide
ccatatcactctcctc

SEQ ID NO: 2001 - DNA, 16 bp, Artificial sequence
  Synthetic oligonucleotide
cgaacaccttgagcca

SEQ ID NO: 2002 - DNA, 16 bp, Artificial sequence
  Synthetic oligonucleotide
ggcccagcttaagagg

SEQ ID NO: 2003 - DNA, 16 bp, Artificial sequence
  Synthetic oligonucleotide
ctgatactcctaatcc

SEQ ID NO: 2004 - DNA, 16 bp, Artificial sequence
  Synthetic oligonucleotide
gcctgtagggctgtgc

SEQ ID NO: 2005 - DNA, 16 bp, Artificial sequence
  Synthetic oligonucleotide
tgccctttctccctac

SEQ ID NO: 2006 - DNA, 16 bp, Artificial sequence
  Synthetic oligonucleotide
agtgcatgtcagtacc

SEQ ID NO: 2007 - DNA, 16 bp, Artificial sequence
  Synthetic oligonucleotide
tgctcctcagctgttg

SEQ ID NO: 2008 - DNA, 16 bp, Artificial sequence
  Synthetic oligonucleotide
gtttgggaccatccct

SEQ ID NO: 2009 - DNA, 16 bp, Artificial sequence
  Synthetic oligonucleotide
agtgctctctagggtc

SEQ ID NO: 2010 - DNA, 16 bp, Artificial sequence
  Synthetic oligonucleotide
tacagagaatcacccc

SEQ ID NO: 2011 - DNA, 16 bp, Artificial sequence
  Synthetic oligonucleotide
gtccaagtaaggtgct

SEQ ID NO: 2012 - DNA, 16 bp, Artificial sequence
  Synthetic oligonucleotide
gaccttgcaggcttcc

SEQ ID NO: 2013 - DNA, 16 bp, Artificial sequence
  Synthetic oligonucleotide
gggcaaaggatcctct

SEQ ID NO: 2014 - DNA, 16 bp, Artificial sequence
  Synthetic oligonucleotide
cccattctgctatccc

SEQ ID NO: 2015 - DNA, 16 bp, Artificial sequence
  Synthetic oligonucleotide
gctgactaggagggct

SEQ ID NO: 2016 - DNA, 16 bp, Artificial sequence
  Synthetic oligonucleotide
cctgtgaggtagtacc

SEQ ID NO: 2017 - DNA, 16 bp, Artificial sequence
  Synthetic oligonucleotide
gtccccctccagtcta

SEQ ID NO: 2018 - DNA, 16 bp, Artificial sequence
  Synthetic oligonucleotide
gaggactcaattcctc

SEQ ID NO: 2019 - DNA, 16 bp, Artificial sequence
  Synthetic oligonucleotide
gacaaggtccttttgg

SEQ ID NO: 2020 - DNA, 16 bp, Artificial sequence
  Synthetic oligonucleotide
gctcttgtgtgcaccc

SEQ ID NO: 2021 - DNA, 16 bp, Artificial sequence
  Synthetic oligonucleotide
tcaccgcctgcaccac

SEQ ID NO: 2022 - DNA, 16 bp, Artificial sequence
  Synthetic oligonucleotide
ggttgcactgtgcaat

SEQ ID NO: 2023 - DNA, 16 bp, Artificial sequence
  Synthetic oligonucleotide
ttccacaggcctccat

SEQ ID NO: 2024 - DNA, 16 bp, Artificial sequence
  Synthetic oligonucleotide
gctgagttccatatgc

SEQ ID NO: 2025 - DNA, 16 bp, Artificial sequence
  Synthetic oligonucleotide
gaaccgccacctcagg

SEQ ID NO: 2026 - DNA, 16 bp, Artificial sequence
  Synthetic oligonucleotide
gctcacggttggagac

SEQ ID NO: 2027 - DNA, 16 bp, Artificial sequence
  Synthetic oligonucleotide
tgggctcccatgttca

SEQ ID NO: 2028 - DNA, 16 bp, Artificial sequence
  Synthetic oligonucleotide
tcactctaccaacctc

SEQ ID NO: 2029 - DNA, 16 bp, Artificial sequence
  Synthetic oligonucleotide
tccttgcttacagatg

SEQ ID NO: 2030 - DNA, 16 bp, Artificial sequence
  Synthetic oligonucleotide
tgatgctagcattacc

SEQ ID NO: 2031 - DNA, 16 bp, Artificial sequence
  Synthetic oligonucleotide
tgggtaactggctagt

SEQ ID NO: 2032 - DNA, 16 bp, Artificial sequence
  Synthetic oligonucleotide
aaccattcctcaccaa

SEQ ID NO: 2033 - DNA, 16 bp, Artificial sequence
  Synthetic oligonucleotide
gccctgaacagttgat

SEQ ID NO: 2034 - DNA, 16 bp, Artificial sequence
  Synthetic oligonucleotide
ggctcctatcatacct

SEQ ID NO: 2035 - DNA, 16 bp, Artificial sequence
  Synthetic oligonucleotide
taggtctcacaaccct

SEQ ID NO: 2036 - DNA, 16 bp, Artificial sequence
  Synthetic oligonucleotide
gtgcattagtcttcca

SEQ ID NO: 2037 - DNA, 16 bp, Artificial sequence
  Synthetic oligonucleotide
caaaagccaggttagc

SEQ ID NO: 2038 - DNA, 16 bp, Artificial sequence
  Synthetic oligonucleotide
ctgctgttgactacct

SEQ ID NO: 2039 - DNA, 16 bp, Artificial sequence
  Synthetic oligonucleotide
gtacctgccagctact

SEQ ID NO: 2040 - DNA, 16 bp, Artificial sequence
  Synthetic oligonucleotide
cctacctttgctgttt

SEQ ID NO: 2041 - DNA, 16 bp, Artificial sequence
  Synthetic oligonucleotide
agtcaccagcctaagc

SEQ ID NO: 2042 - DNA, 16 bp, Artificial sequence
  Synthetic oligonucleotide
aggcaacctgggagtg

SEQ ID NO: 2043 - DNA, 16 bp, Artificial sequence
  Synthetic oligonucleotide
tggccttcacaatggc

SEQ ID NO: 2044 - DNA, 16 bp, Artificial sequence
  Synthetic oligonucleotide
ggtgaagtgggttgga

SEQ ID NO: 2045 - DNA, 16 bp, Artificial sequence
  Synthetic oligonucleotide
gctggttgtctgctgc

SEQ ID NO: 2046 - DNA, 16 bp, Artificial sequence
  Synthetic oligonucleotide
agtttgtgacccctgc

SEQ ID NO: 2047 - DNA, 16 bp, Artificial sequence
  Synthetic oligonucleotide
ccactcagtgtgaatg

SEQ ID NO: 2048 - DNA, 16 bp, Artificial sequence
  Synthetic oligonucleotide
ctggcctcagggcaat

SEQ ID NO: 2049 - DNA, 16 bp, Artificial sequence
  Synthetic oligonucleotide
gtagacttgggtaggt

SEQ ID NO: 2050 - DNA, 16 bp, Artificial sequence
  Synthetic oligonucleotide
tggtgctaagctctcc

SEQ ID NO: 2051 - DNA, 16 bp, Artificial sequence
  Synthetic oligonucleotide
catgctcaagctggaa

SEQ ID NO: 2052 - DNA, 16 bp, Artificial sequence
  Synthetic oligonucleotide
aaggtcaacagcagct

SEQ ID NO: 2053 - DNA, 16 bp, Artificial sequence
  Synthetic oligonucleotide
caaggtcaacagcagc

SEQ ID NO: 2054 - DNA, 16 bp, Artificial sequence
  Synthetic oligonucleotide
ccaaggtcaacagcag

SEQ ID NO: 2055 - DNA, 16 bp, Artificial sequence
  Synthetic oligonucleotide
gccaaggtcaacagca

SEQ ID NO: 2056 - DNA, 16 bp, Artificial sequence
  Synthetic oligonucleotide
tctcacacgcacttca

SEQ ID NO: 2057 - DNA, 16 bp, Artificial sequence
  Synthetic oligonucleotide
atctcacacgcacttc

SEQ ID NO: 2058 - DNA, 16 bp, Artificial sequence
  Synthetic oligonucleotide
gatctcacacgcactt

SEQ ID NO: 2059 - DNA, 16 bp, Artificial sequence
  Synthetic oligonucleotide
ctttcatgaatcaagc

SEQ ID NO: 2060 - DNA, 16 bp, Artificial sequence
  Synthetic oligonucleotide
tctttcatgaatcaag

SEQ ID NO: 2061 - DNA, 16 bp, Artificial sequence
  Synthetic oligonucleotide
gtctttcatgaatcaa

SEQ ID NO: 2062 - DNA, 16 bp, Artificial sequence
  Synthetic oligonucleotide
ggtctttcatgaatca

SEQ ID NO: 2063 - DNA, 16 bp, Artificial sequence
  Synthetic oligonucleotide
atggtctttcatgaat

SEQ ID NO: 2064 - DNA, 16 bp, Artificial sequence
  Synthetic oligonucleotide
gatggtctttcatgaa

SEQ ID NO: 2065 - DNA, 16 bp, Artificial sequence
  Synthetic oligonucleotide
tgatggtctttcatga

SEQ ID NO: 2066 - DNA, 16 bp, Artificial sequence
  Synthetic oligonucleotide
tatatcaatattctcc

SEQ ID NO: 2067 - DNA, 16 bp, Artificial sequence
  Synthetic oligonucleotide
ttatatcaatattctc

SEQ ID NO: 2068 - DNA, 16 bp, Artificial sequence
  Synthetic oligonucleotide
gttatatcaatattct

SEQ ID NO: 2069 - DNA, 16 bp, Artificial sequence
  Synthetic oligonucleotide
tttctttagcaatagt

SEQ ID NO: 2070 - DNA, 16 bp, Artificial sequence
  Synthetic oligonucleotide
ctttctttagcaatag

SEQ ID NO: 2071 - DNA, 16 bp, Artificial sequence
  Synthetic oligonucleotide
gctttctttagcaata

SEQ ID NO: 2072 - DNA, 16 bp, Artificial sequence
  Synthetic oligonucleotide
ctccattagggttctg

SEQ ID NO: 2073 - DNA, 16 bp, Artificial sequence
  Synthetic oligonucleotide
tctccattagggttct

SEQ ID NO: 2074 - DNA, 16 bp, Artificial sequence
  Synthetic oligonucleotide
ttctccattagggttc

SEQ ID NO: 2075 - DNA, 16 bp, Artificial sequence
  Synthetic oligonucleotide
gttctccattagggtt

SEQ ID NO: 2076 - DNA, 16 bp, Artificial sequence
  Synthetic oligonucleotide
aggttggcagacagac

SEQ ID NO: 2077 - DNA, 16 bp, Artificial sequence
  Synthetic oligonucleotide
caggttggcagacaga

SEQ ID NO: 2078 - DNA, 16 bp, Artificial sequence
  Synthetic oligonucleotide
gcaggttggcagacag

SEQ ID NO: 2079 - DNA, 16 bp, Artificial sequence
  Synthetic oligonucleotide
cttcttgtgagctggc

SEQ ID NO: 2080 - DNA, 16 bp, Artificial sequence
  Synthetic oligonucleotide
tcttcttgtgagctgg

SEQ ID NO: 2081 - DNA, 16 bp, Artificial sequence
  Synthetic oligonucleotide
gtcttcttgtgagctg

SEQ ID NO: 2082 - DNA, 16 bp, Artificial sequence
  Synthetic oligonucleotide
agtcttcttgtgagct

SEQ ID NO: 2083 - DNA, 16 bp, Artificial sequence
  Synthetic oligonucleotide
tcttccactcacatcc

SEQ ID NO: 2084 - DNA, 16 bp, Artificial sequence
  Synthetic oligonucleotide
ctcttccactcacatc

SEQ ID NO: 2085 - DNA, 16 bp, Artificial sequence
  Synthetic oligonucleotide
tctcttccactcacat

SEQ ID NO: 2086 - DNA, 16 bp, Artificial sequence
  Synthetic oligonucleotide
gtctcttccactcaca

SEQ ID NO: 2087 - DNA, 16 bp, Artificial sequence
  Synthetic oligonucleotide
atagattttgacttcc

SEQ ID NO: 2088 - DNA, 16 bp, Artificial sequence
  Synthetic oligonucleotide
catagattttgacttc

SEQ ID NO: 2089 - DNA, 16 bp, Artificial sequence
  Synthetic oligonucleotide
gcatagattttgactt

SEQ ID NO: 2090 - DNA, 16 bp, Artificial sequence
  Synthetic oligonucleotide
aaatgtcaacagtgca

SEQ ID NO: 2091 - DNA, 16 bp, Artificial sequence
  Synthetic oligonucleotide
catgactatgttctgg

SEQ ID NO: 2092 - DNA, 16 bp, Artificial sequence
  Synthetic oligonucleotide
acatgactatgttctg

SEQ ID NO: 2093 - DNA, 16 bp, Artificial sequence
  Synthetic oligonucleotide
cacatgactatgttct

SEQ ID NO: 2094 - DNA, 16 bp, Artificial sequence
  Synthetic oligonucleotide
gaattctgagctctgg

SEQ ID NO: 2095 - DNA, 16 bp, Artificial sequence
  Synthetic oligonucleotide
tgaattctgagctctg

SEQ ID NO: 2096 - DNA, 16 bp, Artificial sequence
  Synthetic oligonucleotide
ctgaattctgagctct

SEQ ID NO: 2097 - DNA, 16 bp, Artificial sequence
  Synthetic oligonucleotide
cctgaattctgagctc

SEQ ID NO: 2098 - DNA, 16 bp, Artificial sequence
  Synthetic oligonucleotide
gcctgaattctgagct

SEQ ID NO: 2099 - DNA, 16 bp, Artificial sequence
  Synthetic oligonucleotide
agcctgaattctgagc

SEQ ID NO: 2100 - DNA, 16 bp, Artificial sequence
  Synthetic oligonucleotide
atattgtaattcttgg

SEQ ID NO: 2101 - DNA, 16 bp, Artificial sequence
  Synthetic oligonucleotide
gatattgtaattcttg

SEQ ID NO: 2102 - DNA, 16 bp, Artificial sequence
  Synthetic oligonucleotide
tgatattgtaattctt

SEQ ID NO: 2103 - DNA, 16 bp, Artificial sequence
  Synthetic oligonucleotide
ctgatattgtaattct

SEQ ID NO: 2104 - DNA, 16 bp, Artificial sequence
  Synthetic oligonucleotide
cctgatattgtaattc

SEQ ID NO: 2105 - DNA, 16 bp, Artificial sequence
  Synthetic oligonucleotide
gcctgatattgtaatt

SEQ ID NO: 2106 - DNA, 16 bp, Artificial sequence
  Synthetic oligonucleotide
tgcctgatattgtaat

SEQ ID NO: 2107 - DNA, 16 bp, Artificial sequence
  Synthetic oligonucleotide
attatgtgctttgcct

SEQ ID NO: 2108 - DNA, 16 bp, Artificial sequence
  Synthetic oligonucleotide
aattatgtgctttgcc

SEQ ID NO: 2109 - DNA, 16 bp, Artificial sequence
  Synthetic oligonucleotide
caattatgtgctttgc

SEQ ID NO: 2110 - DNA, 16 bp, Artificial sequence
  Synthetic oligonucleotide
tcaattatgtgctttg

SEQ ID NO: 2111 - DNA, 16 bp, Artificial sequence
  Synthetic oligonucleotide
gtcaattatgtgcttt

SEQ ID NO: 2112 - DNA, 16 bp, Artificial sequence
  Synthetic oligonucleotide
gccatcaccaaacacc

SEQ ID NO: 2113 - DNA, 16 bp, Artificial sequence
  Synthetic oligonucleotide
tgccatcaccaaacac

SEQ ID NO: 2114 - DNA, 16 bp, Artificial sequence
  Synthetic oligonucleotide
ttgccatcaccaaaca

SEQ ID NO: 2115 - DNA, 16 bp, Artificial sequence
  Synthetic oligonucleotide
tggtgactctgcctga

SEQ ID NO: 2116 - DNA, 16 bp, Artificial sequence
  Synthetic oligonucleotide
ctggtgactctgcctg

SEQ ID NO: 2117 - DNA, 16 bp, Artificial sequence
  Synthetic oligonucleotide
gctggtgactctgcct

SEQ ID NO: 2118 - DNA, 16 bp, Artificial sequence
  Synthetic oligonucleotide
tgctggtgactctgcc

SEQ ID NO: 2119 - DNA, 16 bp, Artificial sequence
  Synthetic oligonucleotide
ctgctggtgactctgc

SEQ ID NO: 2120 - DNA, 16 bp, Artificial sequence
  Synthetic oligonucleotide
agtagtcaatattatt

SEQ ID NO: 2121 - DNA, 16 bp, Artificial sequence
  Synthetic oligonucleotide
cagtagtcaatattat

SEQ ID NO: 2122 - DNA, 16 bp, Artificial sequence
  Synthetic oligonucleotide
ccagtagtcaatatta

SEQ ID NO: 2123 - DNA, 16 bp, Artificial sequence
  Synthetic oligonucleotide
cctttgggtgaatagc

SEQ ID NO: 2124 - DNA, 16 bp, Artificial sequence
  Synthetic oligonucleotide
acctttgggtgaatag

SEQ ID NO: 2125 - DNA, 16 bp, Artificial sequence
  Synthetic oligonucleotide
cacctttgggtgaata

SEQ ID NO: 2126 - DNA, 16 bp, Artificial sequence
  Synthetic oligonucleotide
caacttgaggacaata

SEQ ID NO: 2127 - DNA, 16 bp, Artificial sequence
  Synthetic oligonucleotide
ctcaacttgaggacaa

SEQ ID NO: 2128 - DNA, 16 bp, Artificial sequence
  Synthetic oligonucleotide
caggaagaaaggaacc

SEQ ID NO: 2129 - DNA, 16 bp, Artificial sequence
  Synthetic oligonucleotide
ccaggaagaaaggaac

SEQ ID NO: 2130 - DNA, 16 bp, Artificial sequence
  Synthetic oligonucleotide
accaggaagaaaggaa

SEQ ID NO: 2131 - DNA, 16 bp, Artificial sequence
  Synthetic oligonucleotide
tgcagtcatgtacaca

SEQ ID NO: 2132 - DNA, 16 bp, Artificial sequence
  Synthetic oligonucleotide
ctgcagtcatgtacac

SEQ ID NO: 2133 - DNA, 16 bp, Artificial sequence
  Synthetic oligonucleotide
tctgcagtcatgtaca

SEQ ID NO: 2134 - DNA, 16 bp, Artificial sequence
  Synthetic oligonucleotide
tggtttgtcaatcctt

SEQ ID NO: 2135 - DNA, 16 bp, Artificial sequence
  Synthetic oligonucleotide
cttggtttgtcaatcc

SEQ ID NO: 2136 - DNA, 16 bp, Artificial sequence
  Synthetic oligonucleotide
gctacaatgcacagga

SEQ ID NO: 2137 - DNA, 16 bp, Artificial sequence
  Synthetic oligonucleotide
tgctacaatgcacagg

SEQ ID NO: 2138 - DNA, 16 bp, Artificial sequence
  Synthetic oligonucleotide
gatatttattgctgta

SEQ ID NO: 2139 - DNA, 16 bp, Artificial sequence
  Synthetic oligonucleotide
tgatatttattgctgt

SEQ ID NO: 2140 - DNA, 16 bp, Artificial sequence
  Synthetic oligonucleotide
ctgatatttattgctg

SEQ ID NO: 2141 - DNA, 16 bp, Artificial sequence
  Synthetic oligonucleotide
agggtctttacaaagt

SEQ ID NO: 2142 - DNA, 16 bp, Artificial sequence
  Synthetic oligonucleotide
cagggtctttacaaag

SEQ ID NO: 2143 - DNA, 16 bp, Artificial sequence
  Synthetic oligonucleotide
ccagggtctttacaaa

SEQ ID NO: 2144 - DNA, 16 bp, Artificial sequence
  Synthetic oligonucleotide
ttctgcagtatcctag

SEQ ID NO: 2145 - DNA, 16 bp, Artificial sequence
  Synthetic oligonucleotide
tttctgcagtatccta

SEQ ID NO: 2146 - DNA, 16 bp, Artificial sequence
  Synthetic oligonucleotide
gtttctgcagtatcct

SEQ ID NO: 2147 - DNA, 16 bp, Artificial sequence
  Synthetic oligonucleotide
agtttctgcagtatcc

SEQ ID NO: 2148 - DNA, 16 bp, Artificial sequence
  Synthetic oligonucleotide
cagtttctgcagtatc

SEQ ID NO: 2149 - DNA, 16 bp, Artificial sequence
  Synthetic oligonucleotide
caaattccagtcctag

SEQ ID NO: 2150 - DNA, 16 bp, Artificial sequence
  Synthetic oligonucleotide
ccaaattccagtccta

SEQ ID NO: 2151 - DNA, 16 bp, Artificial sequence
  Synthetic oligonucleotide
tccaaattccagtcct

SEQ ID NO: 2152 - DNA, 16 bp, Artificial sequence
  Synthetic oligonucleotide
acccatttcatccatt

SEQ ID NO: 2153 - DNA, 16 bp, Artificial sequence
  Synthetic oligonucleotide
aacccatttcatccat

SEQ ID NO: 2154 - DNA, 16 bp, Artificial sequence
  Synthetic oligonucleotide
gaacccatttcatcca

SEQ ID NO: 2155 - DNA, 16 bp, Artificial sequence
  Synthetic oligonucleotide
ggaacccatttcatcc

SEQ ID NO: 2156 - DNA, 16 bp, Artificial sequence
  Synthetic oligonucleotide
aggaacccatttcatc

SEQ ID NO: 2157 - DNA, 16 bp, Artificial sequence
  Synthetic oligonucleotide
gcttcatgtctttcta

SEQ ID NO: 2158 - DNA, 16 bp, Artificial sequence
  Synthetic oligonucleotide
tgcttcatgtctttct

SEQ ID NO: 2159 - DNA, 16 bp, Artificial sequence
  Synthetic oligonucleotide
gtgcttcatgtctttc

SEQ ID NO: 2160 - DNA, 16 bp, Artificial sequence
  Synthetic oligonucleotide
tgagcttagcagtcac

SEQ ID NO: 2161 - DNA, 16 bp, Artificial sequence
  Synthetic oligonucleotide
atgagcttagcagtca

SEQ ID NO: 2162 - DNA, 16 bp, Artificial sequence
  Synthetic oligonucleotide
catgagcttagcagtc

SEQ ID NO: 2163 - DNA, 16 bp, Artificial sequence
  Synthetic oligonucleotide
tacagacatagctcta

SEQ ID NO: 2164 - DNA, 16 bp, Artificial sequence
  Synthetic oligonucleotide
atacagacatagctct

SEQ ID NO: 2165 - DNA, 16 bp, Artificial sequence
  Synthetic oligonucleotide
gatacagacatagctc

SEQ ID NO: 2166 - DNA, 16 bp, Artificial sequence
  Synthetic oligonucleotide
ggatacagacatagct

SEQ ID NO: 2167 - DNA, 16 bp, Artificial sequence
  Synthetic oligonucleotide
tgtggctttaattcac

SEQ ID NO: 2168 - DNA, 16 bp, Artificial sequence
  Synthetic oligonucleotide
atgtggctttaattca

SEQ ID NO: 2169 - DNA, 16 bp, Artificial sequence
  Synthetic oligonucleotide
tatgtggctttaattc

SEQ ID NO: 2170 - DNA, 16 bp, Artificial sequence
  Synthetic oligonucleotide
tgttcagttgcatcac

SEQ ID NO: 2171 - DNA, 16 bp, Artificial sequence
  Synthetic oligonucleotide
gtgttcagttgcatca

SEQ ID NO: 2172 - DNA, 16 bp, Artificial sequence
  Synthetic oligonucleotide
tgtgttcagttgcatc

SEQ ID NO: 2173 - DNA, 16 bp, Artificial sequence
  Synthetic oligonucleotide
catctggatgtgaggc

SEQ ID NO: 2174 - DNA, 16 bp, Artificial sequence
  Synthetic oligonucleotide
acatctggatgtgagg

SEQ ID NO: 2175 - DNA, 16 bp, Artificial sequence
  Synthetic oligonucleotide
cacatctggatgtgag

SEQ ID NO: 2176 - DNA, 16 bp, Artificial sequence
  Synthetic oligonucleotide
tcaggtaatttctgga

SEQ ID NO: 2177 - DNA, 16 bp, Artificial sequence
  Synthetic oligonucleotide
ctcaggtaatttctgg

SEQ ID NO: 2178 - DNA, 16 bp, Artificial sequence
  Synthetic oligonucleotide
tctcaggtaatttctg

SEQ ID NO: 2179 - DNA, 16 bp, Artificial sequence
  Synthetic oligonucleotide
tgcttatttacctggg

SEQ ID NO: 2180 - DNA, 16 bp, Artificial sequence
  Synthetic oligonucleotide
ttgcttatttacctgg

SEQ ID NO: 2181 - DNA, 16 bp, Artificial sequence
  Synthetic oligonucleotide
tttgcttatttacctg

SEQ ID NO: 2182 - DNA, 16 bp, Artificial sequence
  Synthetic oligonucleotide
ttttgcttatttacct

SEQ ID NO: 2183 - DNA, 16 bp, Artificial sequence
  Synthetic oligonucleotide
atgatgttactactac

SEQ ID NO: 2184 - DNA, 16 bp, Artificial sequence
  Synthetic oligonucleotide
aatgatgttactacta

SEQ ID NO: 2185 - DNA, 16 bp, Artificial sequence
  Synthetic oligonucleotide
caatgatgttactact

SEQ ID NO: 2186 - DNA, 16 bp, Artificial sequence
  Synthetic oligonucleotide
cccctagagcaatggt

SEQ ID NO: 2187 - DNA, 16 bp, Artificial sequence
  Synthetic oligonucleotide
ccccctagagcaatgg

SEQ ID NO: 2188 - DNA, 16 bp, Artificial sequence
  Synthetic oligonucleotide
tccccctagagcaatg

SEQ ID NO: 2189 - DNA, 16 bp, Artificial sequence
  Synthetic oligonucleotide
tcaattgcagatgctc

SEQ ID NO: 2190 - DNA, 16 bp, Artificial sequence
  Synthetic oligonucleotide
ctcaattgcagatgct

SEQ ID NO: 2191 - DNA, 16 bp, Artificial sequence
  Synthetic oligonucleotide
gctcaattgcagatgc

SEQ ID NO: 2192 - DNA, 16 bp, Artificial sequence
  Synthetic oligonucleotide
agctcaattgcagatg

SEQ ID NO: 2193 - DNA, 16 bp, Artificial sequence
  Synthetic oligonucleotide
gtatattcagtccaag

SEQ ID NO: 2194 - DNA, 16 bp, Artificial sequence
  Synthetic oligonucleotide
agtatattcagtccaa

SEQ ID NO: 2195 - DNA, 16 bp, Artificial sequence
  Synthetic oligonucleotide
cagtatattcagtcca

SEQ ID NO: 2196 - DNA, 16 bp, Artificial sequence
  Synthetic oligonucleotide
acctccgagcttcgcc

SEQ ID NO: 2197 - DNA, 16 bp, Artificial sequence
  Synthetic oligonucleotide
gtaggacctccgagct

SEQ ID NO: 2198 - DNA, 16 bp, Artificial sequence
  Synthetic oligonucleotide
acctgtaggacctccg

SEQ ID NO: 2199 - DNA, 16 bp, Artificial sequence
  Synthetic oligonucleotide
cagtgccaaggtcaac

SEQ ID NO: 2200 - DNA, 16 bp, Artificial sequence
  Synthetic oligonucleotide
acttgatcctgccagt

SEQ ID NO: 2201 - DNA, 16 bp, Artificial sequence
  Synthetic oligonucleotide
ctcgctcaggtgaacg

SEQ ID NO: 2202 - DNA, 16 bp, Artificial sequence
  Synthetic oligonucleotide
agtctctcgctcaggt

SEQ ID NO: 2203 - DNA, 16 bp, Artificial sequence
  Synthetic oligonucleotide
ccttctggtatagaac

SEQ ID NO: 2204 - DNA, 16 bp, Artificial sequence
  Synthetic oligonucleotide
gctagttagcttgata

SEQ ID NO: 2205 - DNA, 16 bp, Artificial sequence
  Synthetic oligonucleotide
tctggttgcactattt

SEQ ID NO: 2206 - DNA, 16 bp, Artificial sequence
  Synthetic oligonucleotide
ggatctggttgcacta

SEQ ID NO: 2207 - DNA, 16 bp, Artificial sequence
  Synthetic oligonucleotide
ggtggatctggttgca

SEQ ID NO: 2208 - DNA, 16 bp, Artificial sequence
  Synthetic oligonucleotide
gcaatgggtggatctg

SEQ ID NO: 2209 - DNA, 16 bp, Artificial sequence
  Synthetic oligonucleotide
cagttgagggcaatgg

SEQ ID NO: 2210 - DNA, 16 bp, Artificial sequence
  Synthetic oligonucleotide
agtccagttgagggca

SEQ ID NO: 2211 - DNA, 16 bp, Artificial sequence
  Synthetic oligonucleotide
gtaaagtccagttgag

SEQ ID NO: 2212 - DNA, 16 bp, Artificial sequence
  Synthetic oligonucleotide
gttcagtaaagtccag

SEQ ID NO: 2213 - DNA, 16 bp, Artificial sequence
  Synthetic oligonucleotide
ctgcatgaatcccagt

SEQ ID NO: 2214 - DNA, 16 bp, Artificial sequence
  Synthetic oligonucleotide
acatagagcacctcac

SEQ ID NO: 2215 - DNA, 16 bp, Artificial sequence
  Synthetic oligonucleotide
gttacatagagcacct

SEQ ID NO: 2216 - DNA, 16 bp, Artificial sequence
  Synthetic oligonucleotide
agtgttacatagagca

SEQ ID NO: 2217 - DNA, 16 bp, Artificial sequence
  Synthetic oligonucleotide
tccttgaggagatctg

SEQ ID NO: 2218 - DNA, 16 bp, Artificial sequence
  Synthetic oligonucleotide
gctatcatgaatggct

SEQ ID NO: 2219 - DNA, 16 bp, Artificial sequence
  Synthetic oligonucleotide
cgggtttatagctatc

SEQ ID NO: 2220 - DNA, 16 bp, Artificial sequence
  Synthetic oligonucleotide
atccttcacccctagg

SEQ ID NO: 2221 - DNA, 16 bp, Artificial sequence
  Synthetic oligonucleotide
gagtcgccatccttca

SEQ ID NO: 2222 - DNA, 16 bp, Artificial sequence
  Synthetic oligonucleotide
tccagagtcgccatcc

SEQ ID NO: 2223 - DNA, 16 bp, Artificial sequence
  Synthetic oligonucleotide
ggctgagcaacctctg

SEQ ID NO: 2224 - DNA, 16 bp, Artificial sequence
  Synthetic oligonucleotide
ctgtggctgagcaacc

SEQ ID NO: 2225 - DNA, 16 bp, Artificial sequence
  Synthetic oligonucleotide
gataacactgggctgc

SEQ ID NO: 2226 - DNA, 16 bp, Artificial sequence
  Synthetic oligonucleotide
tgcttggataacactg

SEQ ID NO: 2227 - DNA, 16 bp, Artificial sequence
  Synthetic oligonucleotide
ctctgcttggataaca

SEQ ID NO: 2228 - DNA, 16 bp, Artificial sequence
  Synthetic oligonucleotide
gctgaatatgggcagc

SEQ ID NO: 2229 - DNA, 16 bp, Artificial sequence
  Synthetic oligonucleotide
cttggattgcttagct

SEQ ID NO: 2230 - DNA, 16 bp, Artificial sequence
  Synthetic oligonucleotide
cctgggcataaaagtc

SEQ ID NO: 2231 - DNA, 16 bp, Artificial sequence
  Synthetic oligonucleotide
accttgatgtgaggag

SEQ ID NO: 2232 - DNA, 16 bp, Artificial sequence
  Synthetic oligonucleotide
gattcaaccttgatgt

SEQ ID NO: 2233 - DNA, 16 bp, Artificial sequence
  Synthetic oligonucleotide
atgtgtgattcaacct

SEQ ID NO: 2234 - DNA, 16 bp, Artificial sequence
  Synthetic oligonucleotide
tgggacaggcatctca

SEQ ID NO: 2235 - DNA, 16 bp, Artificial sequence
  Synthetic oligonucleotide
tagtctgggacaggca

SEQ ID NO: 2236 - DNA, 16 bp, Artificial sequence
  Synthetic oligonucleotide
ggaggtatagtctggg

SEQ ID NO: 2237 - DNA, 16 bp, Artificial sequence
  Synthetic oligonucleotide
ggactgtactatatga

SEQ ID NO: 2238 - DNA, 16 bp, Artificial sequence
  Synthetic oligonucleotide
tcagttggtctgtgct

SEQ ID NO: 2239 - DNA, 16 bp, Artificial sequence
  Synthetic oligonucleotide
gctaaggcatgatttt

SEQ ID NO: 2240 - DNA, 16 bp, Artificial sequence
  Synthetic oligonucleotide
gccatgcttgaagtct

SEQ ID NO: 2241 - DNA, 16 bp, Artificial sequence
  Synthetic oligonucleotide
atagccatgcttgaag

SEQ ID NO: 2242 - DNA, 16 bp, Artificial sequence
  Synthetic oligonucleotide
acacagtgtgtagtgt

SEQ ID NO: 2243 - DNA, 16 bp, Artificial sequence
  Synthetic oligonucleotide
ctgcagtacacagtgt

SEQ ID NO: 2244 - DNA, 16 bp, Artificial sequence
  Synthetic oligonucleotide
accaactgcagtacac

SEQ ID NO: 2245 - DNA, 16 bp, Artificial sequence
  Synthetic oligonucleotide
tagactgtagttgcta

SEQ ID NO: 2246 - DNA, 16 bp, Artificial sequence
  Synthetic oligonucleotide
accagctttagactgt

SEQ ID NO: 2247 - DNA, 16 bp, Artificial sequence
  Synthetic oligonucleotide
gtaagttgatctgtgc

SEQ ID NO: 2248 - DNA, 16 bp, Artificial sequence
  Synthetic oligonucleotide
tacttcttttggtgcc

SEQ ID NO: 2249 - DNA, 16 bp, Artificial sequence
  Synthetic oligonucleotide
tcttgtaccttattcc

SEQ ID NO: 2250 - DNA, 16 bp, Artificial sequence
  Synthetic oligonucleotide
tggttataggctgtga

SEQ ID NO: 2251 - DNA, 16 bp, Artificial sequence
  Synthetic oligonucleotide
gtctggttataggctg

SEQ ID NO: 2252 - DNA, 16 bp, Artificial sequence
  Synthetic oligonucleotide
atgtgtctggttatag

SEQ ID NO: 2253 - DNA, 16 bp, Artificial sequence
  Synthetic oligonucleotide
gagtatgtgtctggtt

SEQ ID NO: 2254 - DNA, 16 bp, Artificial sequence
  Synthetic oligonucleotide
ggtctgcgataaatgg

SEQ ID NO: 2255 - DNA, 16 bp, Artificial sequence
  Synthetic oligonucleotide
gccagacacaactagt

SEQ ID NO: 2256 - DNA, 16 bp, Artificial sequence
  Synthetic oligonucleotide
accgccactgtagcag

SEQ ID NO: 2257 - DNA, 16 bp, Artificial sequence
  Synthetic oligonucleotide
ccgccaccgccactgt

SEQ ID NO: 2258 - DNA, 16 bp, Artificial sequence
  Synthetic oligonucleotide
gggcctccggcccgcg

SEQ ID NO: 2259 - DNA, 16 bp, Artificial sequence
  Synthetic oligonucleotide
agagcgcgggttcgcg

SEQ ID NO: 2260 - DNA, 16 bp, Artificial sequence
  Synthetic oligonucleotide
tactgaccccagttcc

SEQ ID NO: 2261 - DNA, 16 bp, Artificial sequence
  Synthetic oligonucleotide
actctactgaccccag

SEQ ID NO: 2262 - DNA, 16 bp, Artificial sequence
  Synthetic oligonucleotide
gtcactctactgaccc

SEQ ID NO: 2263 - DNA, 16 bp, Artificial sequence
  Synthetic oligonucleotide
ttcatgcggactggtg

SEQ ID NO: 2264 - DNA, 16 bp, Artificial sequence
  Synthetic oligonucleotide
gtgagcatggacccca

SEQ ID NO: 2265 - DNA, 16 bp, Artificial sequence
  Synthetic oligonucleotide
tgatatgtgagcatgg

SEQ ID NO: 2266 - DNA, 16 bp, Artificial sequence
  Synthetic oligonucleotide
aagttggtgagcttct

SEQ ID NO: 2267 - DNA, 16 bp, Artificial sequence
  Synthetic oligonucleotide
ccttcaagttggtgag

SEQ ID NO: 2268 - DNA, 16 bp, Artificial sequence
  Synthetic oligonucleotide
gtaagatccttttgcc

SEQ ID NO: 2269 - DNA, 16 bp, Artificial sequence
  Synthetic oligonucleotide
cagctgtgcaacttgc

SEQ ID NO: 2270 - DNA, 16 bp, Artificial sequence
  Synthetic oligonucleotide
gccttggtaggtaggg

SEQ ID NO: 2271 - DNA, 16 bp, Artificial sequence
  Synthetic oligonucleotide
agagccttggtaggta

SEQ ID NO: 2272 - DNA, 16 bp, Artificial sequence
  Synthetic oligonucleotide
cccgcacaaacgcgca

SEQ ID NO: 2273 - DNA, 16 bp, Artificial sequence
  Synthetic oligonucleotide
gtcttcaaggtcagtt

SEQ ID NO: 2274 - DNA, 16 bp, Artificial sequence
  Synthetic oligonucleotide
gcccagtgaattcagc

SEQ ID NO: 2275 - DNA, 16 bp, Artificial sequence
  Synthetic oligonucleotide
agatgcgcccagtgaa

SEQ ID NO: 2276 - DNA, 16 bp, Artificial sequence
  Synthetic oligonucleotide
gtaagatgcgcccagt

SEQ ID NO: 2277 - DNA, 16 bp, Artificial sequence
  Synthetic oligonucleotide
ccagaaggcacttgta

SEQ ID NO: 2278 - DNA, 16 bp, Artificial sequence
  Synthetic oligonucleotide
ggaagatttgcagaac

SEQ ID NO: 2279 - DNA, 16 bp, Artificial sequence
  Synthetic oligonucleotide
ccttggtcatggaaga

SEQ ID NO: 2280 - DNA, 16 bp, Artificial sequence
  Synthetic oligonucleotide
tgaccttggtcatgga

SEQ ID NO: 2281 - DNA, 16 bp, Artificial sequence
  Synthetic oligonucleotide
gaggtgaccttggtca

SEQ ID NO: 2282 - DNA, 16 bp, Artificial sequence
  Synthetic oligonucleotide
atccaaagaggtgacc

SEQ ID NO: 2283 - DNA, 16 bp, Artificial sequence
  Synthetic oligonucleotide
gccaatccaaagaggt

SEQ ID NO: 2284 - DNA, 16 bp, Artificial sequence
  Synthetic oligonucleotide
ggtctgccaatccaaa

SEQ ID NO: 2285 - DNA, 16 bp, Artificial sequence
  Synthetic oligonucleotide
ccctgggtctgccaat

SEQ ID NO: 2286 - DNA, 16 bp, Artificial sequence
  Synthetic oligonucleotide
gagatctcaacaaggg

SEQ ID NO: 2287 - DNA, 16 bp, Artificial sequence
  Synthetic oligonucleotide
cgcccatcactcttcc

SEQ ID NO: 2288 - DNA, 16 bp, Artificial sequence
  Synthetic oligonucleotide
cacctgtcgcccatca

SEQ ID NO: 2289 - DNA, 16 bp, Artificial sequence
  Synthetic oligonucleotide
catcacctgtcgccca

SEQ ID NO: 2290 - DNA, 16 bp, Artificial sequence
  Synthetic oligonucleotide
caccatcacctgtcgc

SEQ ID NO: 2291 - DNA, 16 bp, Artificial sequence
  Synthetic oligonucleotide
aatagttgtcaccatc

SEQ ID NO: 2292 - DNA, 16 bp, Artificial sequence
  Synthetic oligonucleotide
gccacctttcatgaga

SEQ ID NO: 2293 - DNA, 16 bp, Artificial sequence
  Synthetic oligonucleotide
ctcttggaagtaggta

SEQ ID NO: 2294 - DNA, 16 bp, Artificial sequence
  Synthetic oligonucleotide
gttctcttggaagtag

SEQ ID NO: 2295 - DNA, 16 bp, Artificial sequence
  Synthetic oligonucleotide
taaacaggttggtctg

SEQ ID NO: 2296 - DNA, 20 bp, Artificial sequence
  Synthetic oligonucleotide
agcttcttgtccagctttat

SEQ ID NO: 2297 - DNA, 21 bp, Artificial sequence
  Synthetic oligonucleotide
agcttcttgtccagctttata

SEQ ID NO: 2298 - DNA, 14 bp, Artificial sequence
  Synthetic oligonucleotide
tcagtcatgacttc

SEQ ID NO: 2299 - DNA, 15 bp, Artificial sequence
  Synthetic oligonucleotide
tcagtcatgacttca

SEQ ID NO: 2300 - DNA, 20 bp, Artificial sequence
  Synthetic oligonucleotide
gctgattagagagaggtccc

SEQ ID NO: 2301 - DNA, 20 bp, Artificial sequence
  Synthetic oligonucleotide
tcccatttcaggagacctgg

SEQ ID NO: 2302 - DNA, 15 bp, Artificial sequence
  Synthetic oligonucleotide
atcagtcatgacttc

SEQ ID NO: 2303 - DNA, 20 bp, Artificial sequence
  Synthetic oligonucleotide
cggtgcaaggcttaggaatt

SEQ ID NO: 2304 - DNA, 20 bp, Artificial sequence
  Synthetic oligonucleotide
gcttcagtcatgacttcctt

SEQ ID NO: 2305 - DNA, 21 bp, Artificial sequence
  Synthetic oligonucleotide
gcttcagtcatgacttcctta

SEQ ID NO: 2306 - DNA, 21 bp, Artificial sequence
  Synthetic oligonucleotide
agcttcagtcatgacttcctt

SEQ ID NO: 2307 - DNA, 20 bp, Artificial sequence
  Synthetic oligonucleotide
tggtaatccactttcagagg

SEQ ID NO: 2308 - DNA, 21 bp, Artificial sequence
  Synthetic oligonucleotide
tggtaatccactttcagagga

SEQ ID NO: 2309 - DNA, 21 bp, Artificial sequence
  Synthetic oligonucleotide
tgcttcagtcatgacttcctt

SEQ ID NO: 2310 - DNA, 20 bp, Artificial sequence
  Synthetic oligonucleotide
cactgatttttgcccaggat

SEQ ID NO: 2311 - DNA, 21 bp, Artificial sequence
  Synthetic oligonucleotide
cactgatttttcgggaggata

SEQ ID NO: 2312 - DNA, 21 bp, Artificial sequence
  Synthetic oligonucleotide
aagcttcttgtccagctttat

SEQ ID NO: 2313 - DNA, 20 bp, Artificial sequence
  Synthetic oligonucleotide
acccaattcagaaggaagga

SEQ ID NO: 2314 - DNA, 21 bp, Artificial sequence
  Synthetic oligonucleotide
acccaattcagaaggaaggaa

SEQ ID NO: 2315 - DNA, 21 bp, Artificial sequence
  Synthetic oligonucleotide
aacccaattcagaaggaagga

SEQ ID NO: 2316 - DNA, 21 bp, Artificial sequence
  Synthetic oligonucleotide
atggtaatccactttcagagg

SEQ ID NO: 2317 - DNA, 20 bp, Artificial sequence
  Synthetic oligonucleotide
tcttggttacatgaaatccc

SEQ ID NO: 2318 - DNA, 21 bp, Artificial sequence
  Synthetic oligonucleotide
tcttggttacatgaaatccca

SEQ ID NO: 2319 - DNA, 20 bp, Artificial sequence
  Synthetic oligonucleotide
attcactttcataatgctgg

SEQ ID NO: 2320 - DNA, 21 bp, Artificial sequence
  Synthetic oligonucleotide
attcactttcataatgctgga

SEQ ID NO: 2321 - DNA, 20 bp, Artificial sequence
  Synthetic oligonucleotide
tgctccgttggtgcttgttc

SEQ ID NO: 2322 - DNA, 21 bp, Artificial sequence
  Synthetic oligonucleotide
atcttggttacatgaaatccc

SEQ ID NO: 2323 - DNA, 20 bp, Artificial sequence
  Synthetic oligonucleotide
atgcatggtgatgcttctga

SEQ ID NO: 2324 - DNA, 20 bp, Artificial sequence
  Synthetic oligonucleotide
cagctttattagggacagca

SEQ ID NO: 2325 - DNA, 21 bp, Artificial sequence
  Synthetic oligonucleotide
cagctttattagggacagcaa

SEQ ID NO: 2326 - DNA, 16 bp, Artificial sequence
  Synthetic oligonucleotide
ttcagtcatgacttcc

SEQ ID NO: 2327 - DNA, 20 bp, Artificial sequence
  Synthetic oligonucleotide
  misc_feature (1)..(5): Bases at these positions are RNA
  misc_feature (16)..(20): Bases at these positions are RNA
gcuucagtcatgactuccuu

SEQ ID NO: 2328 - DNA, 21 bp, Artificial sequence
  Synthetic oligonucleotide
tgctccgttggtgcttgttca

SEQ ID NO: 2329 - DNA, 24 bp, Artificial sequence
  Primer
cgagttcagtgaggtgctctatgt

SEQ ID NO: 2330 - DNA, 26 bp, Artificial sequence
  Primer
aagagccatggaaagtagaaatcttc

SEQ ID NO: 2331 - DNA, 19 bp, Artificial sequence
  Probe
ttcctcagatgagccaatt

SEQ ID NO: 2332 - DNA, 310001 bp, Macaca mulatta
  misc_feature (17323)..(17436): n is a, c, g, or t
  misc_feature (25984)..(26003): n is a, c, g, or t
  misc_feature (107240)..(107259): n is a, c, g, or t
  misc_feature (113595)..(113619): n is a, c, g, or t
  misc_feature (136036)..(136328): n is a, c, g, or t
  misc_feature (140788)..(140807): n is a, c, g, or t
  misc_feature (192868)..(193398): n is a, c, g, or t
  misc_feature (210347)..(210366): n is a, c, g, or t
  misc_feature (218041)..(218671): n is a, c, g, or t
  misc_feature (243838)..(243998): n is a, c, g, or t
  misc_feature (291980)..(292210): n is a, c, g, or t
  misc_feature (293097)..(293542): n is a, c, g, or t
tgtgattggcgtatgtttaaggagaaagaaccagagttcagatgtggacatgtcaagtttcagaggtctgttagacatccaaatggagatatccagttgctagcctggagctctgtggagagatctgggtttgagttataaatccaagagatagaagttttcaatcaatttgattatttattgggcactctatataaaccctacaaatactgggcactaacctagacattacaggtacagatattaagaatatatagtttctccctcagaaatctcttaattaatgagaaaagcagacatataacaaaaactgcaatatttaataaaagaagatataaaggcctataaaggtgctgatacacagagaattaactaataaattccaccctggggaatagtcaggaagagcttcagagagaaggtaaataattgattggaactttaaggcaaagaaggatttctctgggtggacaaagtaggatcttccaagtagagtggaaaccataagcaaatgcagtttcactcttcaaaaggtaaatgtgctctggaatgccttaacttgtaacaaattaatcaactcaatacctgctacattttccctcacaatttggaatatataaagaggcacatactaccatagaccaatacctggtcataaatgagattgagggacctttattcatgaagcttaaaaataaaggctgcccttcatgtcagttgcaggtttatatctagctctataatattaactgaggtgtctttttctatgttttctgtgcatgatgagtttttaaaaatcaaagacagagcagcaggcagagtagtctagtttcatggcacacagaatggaggatattgctgaacccagatttttaaaaaaggaagtcagttcttctttttttaagtatggccctgagctcatctcagagcataaacaatagaatttagaataccttttatgatgccgtctggcacctcctatactagatcaagattctctagctcagggaagaagggcaaaggatgagaaggcacagagaggatataaacagagattggtagtgccaagctctgaagaaggtccaacttggaaggtcatttcagacaggagtggagtcagcatttgaggactgtctggtctctactcctgccaggactgcactgtcagccagcttggcatgtatggaccaccgagcaggagtttttcttgactgtgccctaatcttttactttcccaagtttctctatatgggtacttccccttttaaaagctccagacacagccaagcacccctattgctctagcaaagtatgaaaccccagaaatcaatggtttggggaagagtcttaggggaaataaaagcttccttattcttagatgggatagaacaagagcagttcaggatcaataaccatcccaccccatgataaaacatgccccttccagaacctttccttttttgttcattctaggtgtctatctggaacagctggggtatttgagccacagctaagcttctgaaagtattctaaggaatagtttttcacttacttgattcctttgaaaataggggtatcttatgtgataactgctatcccagagtctttgatcctctgttcgttctcaagtcttggctaccgtgtactacttcaaagctctgtagatattttattctaaagaaaagaaacttggttcctttaagttgttgttgaaacatttctctctgggtataaacttgggttgtatctgggagctctgtttaaaaaaaaaaaaaaatgtctttagtaagccaaagctgttagaagcttataagtaagtgacattacaattgatggtcagtaaatagtggaaagatcgcatgactaacttctccttcagatctgagacaacctggagctagacttttgtactctctgctcagaaaagcacatagtggctcggggtttgatgtagtacaaaaatgacatgcttatgtacaactttaactttctgcagcactttttacaacttcttgtgaatgaagtaggcagggcttgcatttgacagatgaactatgtccagcgtgaggcagagttaaaaccctttccttggctcaggaacttcaggctggggcctgtgtctgctctccctatatccctgtcctctagcagatacctctctgctaacatgctgagtgtcctcggtaaattactcaatctctctgtctccgtcttctaacctccacaataaagcccctcgtagttttaactatctttttcactgcgccccagtgagcaggagtttggaacttaattgctgatggaaaggcaatatttggatggctaaacacgctttccaagctatcttgctgattttcctctcattcctggagataactcatctttttgtaagtgtttctttgagtctgtggattgctcttaacgctcttgtaggtcctgccttcatttgggaacaggggcaggcggaaagaaaaggaagtgtattgcaactaccaatatcttcctctaggaggagctgcgcagcccagatgagagtgacacgcaccaactccagctcctcgccgggaagacttcatcccagcaactcggaacgcttggccggggcggcactcggtctctccgcagcagttctcgaactggcctccttgaacgtcggtttccccttcgcttctgcagcctggatctgggggacggcgggccaggcccggcgtgaccgctggtgaacggtggccgccttttcccacccctgctctcccatcctcccttcccgttttaccccgccccctctctcctccccaagcctgacagcccacgagctgccaagcagggcgcagccatgggaagaggaggagggctagggagcggcggcggcggcggcggcagcggcagcggcggctgctacagtggcggtggcggcggcggctgctgctgagcccgggcggcggcggggaccccgggctgaggccacgcgggccggaggccccagcaccattggccccagcgcagacgcgaacccgcgctctctctccagaggcgaagctcggaggtactggagtggggctccgggagtctggctttattttcctcctgttgtgccagggggcctgagagtgaaccctgggactctagttgtttatgaaaatgggaggatctgtcttatatatttacatggatgattttttatttcggatgacttggctgtgctcccctcctccttgcgaagaagttgttttctgctggtgggttgttgtaacccaatcgagtgtgtgtgtgtgtgtgtgtgtgtgtgtgtgtgtgtgtgtgtgtgtctggaagttggtggaggcggcagggagttgcgggcgacagacgaaccatcccactctggcgtctgctgtggcccgcgagtagggtgcgtggaggggtttactccggagatagttttgttaaagtcataaaagttttgctagtgtgtttctgtttgccatcatctgcctggctgaggcagagctgccgaggctgctgctgctgcgcggggaaggatctccggcagcgagactggagagattgggaaggtcgagctgtgcgcgtgaacacggcgcgcagagcgcgcagtcttttgcgcgtttgtgcgggctgcagccgcacattggcaccggtggaactggggtcagtagagtgacggccaccagtccgcatgaattggcgtaagtggaaattgtggcgagccgtcctccccgagcctccccgagccgtcctccccgagcctctacaactagtggttgtaaaatcaaccaggcttaaagttttgacagaactgccagaggtgcgggtcaatggggtggccgcgtgtctagggagagggcgctggcggcacagagggtgcgggtcagggtcacccacttgcgagtgcgtggggaagtctatttggggcgaatgctttacatatagccggaggagatgcctgctgagaccgagctgcgggggttctcggtctggcgtggactgtgtgtcctgaatgagtgtaagtgtgcgctgtttgcgcgcgcgcgagtgtgcgcctggggaggcgtgtcggcgcctgagccagtcgggtgtgcagggtggaagaggccacagaggtgccgcctgcctgtttgtgcagccaggagaccttggaagggacagagaaaggtaacgggaggccaaagtgttgggaagtcagagtagtttctgcataggattaagtattaagggctttaaaataactaaacccattgccctgagtgactgaggactggaagtgagcgtttggggagttctcaggagaactgcatgggagggcgtttgggaggtctaagagatgtgtaatatgtgtgagtacagaacttcggagacagacacaggttggagctatgaatttgagattttcagggtgctgctgtccacagtccagggactggctggtttcagaggtgttcaggctccctggtgtgtgtgcctgggaagacactcatcttttctcccagacatgggatattgtggcagctcaggttctgtttcctgagcaactggtgttccaggctggtttccacctgaatcaccctagaagtatcttttttctgatgataaatgttgaaacatttccagaaattaaaatgctggatagaaacaaaattgatgcagcagataggattgttagtgattgggagctctttttccctttgagaaaagcaaagcttcgtgttcccagattagatttcaaggagtcttcagttatttacagcttcccttcagatgggcctttggatggagctggaaggatgtgttttggcctagagacctttggaagacatcatgtgtagcttaaaggggttgtcccatctgtcatcatcttcttccacccttgtaaacttttgttttgcattaatctaaggaaagttggtgagtcaacatttagctttttgttgttgttgttgttggagtaaatatatcacagtgaaattatagttgtggtctcctgaaggccatgcaaaccaacacttaatgggcaaaggtgtgaaatgaaagtctataaatgcaatgacaaagtgacgagatgaatgcattcttttttcaaaatgaacataactgtgctcacaaaaatttattctagccaggattgggcccatgttttttatcattagtttttaaacagcagactccacatcataaaccactttaaaatggatactagaggcctatgctatctctggcgcctgcttaaacagatgtttacagtgcttggtaacctatgggattgtcatgttgagtatcttgttagctcaggacataatgtttatagcataatataataaatggagccacagttgcagcatgcttcttccaagtgcatgaagcaaatcttgcatcagggaaacaaattctgcagttggtccaacttggctagccttctttgggtatctcctggtaagcactgttaatgtaaagataaatgtgagtaacacggtgagaaagtaggacagtaaattgtttagcttagtgaaaaaaagcatggattatgctttttaaatctgctaacctgaagattacacttctcaggttataccactggtaaattgcacaactatgagaatttggtttgcttttaaagaacaatttttaagaagtatgtcaataatgaaaataacatatttcttaatgtgtttacatgtgtccatacaagccaatactttttcttctttaaaaagaaccctataatttctgtggtaatgatttaaatgttatgagcattcaaatcacctaatcaccttttcaatcttcaattgataagaatcgaagtctggtaagactggagtcatccctcagccaattgtgtaaacaagacagtacagaatgtctttctggcaagtaatttttttcaacctgaaacagataatataaataatatgtcccataaaagaattacttaggatgataattactttagaggtaattatctggtgcatgaacctccatctgtgaaaatggtctaatctatctcttcttggaaataatcagttggaaatctccctttttcattgttcagtccattctaggaaagattgatttctagaaagttctgccttatactgaatcaacattttcttccatccacttgcctgtccttcaggagctgaccacaatgaatctagtctcttttccctgtgtttaccatacttgaaaacaaacattatgctccttgctgaatccccttttgcctacttttgtagcagtttttcacccactgtagggttccaccctcctctgccttgaaccatatgcccttgattctacattctcattgtattagtctgttctcatgctgctaataaagacatacgtgagactgtgtaatttataaagaaaaagaggtttaatggactcacagttccacatggctggggaggcctcacaatcatttccgaaggtgaaggaggagcaaaggcatgtcttacatgacagcaggcaagaaagcaagtgctttctataaagggaactgccctttatagaaccatcagatctcattagacttattcactatcatgagaacaacatgggaaaaacccacttccatgatttaattaactcctactgggtcccttccaccacatatgggaattatgggaactacagttgaagatgacatttgggtgaagacaaagccaaaccatatcgttccactcctaccccctcctaaatctcatgttttctcatttcaaaagcaatcatgctttcccaacagtcccccaaagtcttaactcatttcagcattagctcaaaaatccacagtccaaagtctcacctgaaccaaggcaagtctcttccacctatgagccagtaaaatcaaaagcaagttagttactttctaaatacaatggaggtacaggcattgtgtaaatatgcctattccaaatgggagaaattggcccaaacagaggggctataggtgcaagtccaaagtctaatagggcagtcatcaaaccttaaagttccgaaatgatctcctttgacttcatgtctcacatccaggtcacactgatgcaaaatgtgggctcccatgaccttgcacagctccgcctctgtggctttgcaggatacaacttctctcctggctgttttcatagctggcgttgatggtggcttttccaggcacatggtgctagctgttagtggatctaccattctgagggctgggggatggtggccctcttctcatagctctactaggcagtaacccagtggggactctgtgtagaggatccaactccacatttcttttccacattgccctagcaggggttctttatgagggctctgcccctgcagcacaactctgcctggacatccaggcatttccttacatcctctgaaatctaggtggaagttcccaaacctcaattcttgtcttctgtgcacctgcaggaccaacaccacgtggaagctgccaaatcttcaggctttcaccctcttcagtcgtggcctgagctgtaccttggccccttttagacatggctggaggggctgggacacagggcaccaagtccctaggctgcacctaacaggcccagaaaaccatgtttcctctaggcctccggacctgtgatgggaggggctgccataaagacctctgacatgttctggagacattttccctattgtgttggtgaccaacatttggcttctcattacttatgtaaatttctgcagcagtcttgaatttctccccagaaaatgggtttttctttcctatggcatcatcagcctgcaaattttccaaacttttatgctcttttcacctcgtgaatgctttgctgcttagaaatttcttctgccagataccctaattaatctctctcaagtttaaagttccacagatctctagggcgggggcaaaatgcctccagtctctttgctaaagcattaacaagagtcacctttgctccagttcccaacaagttcctcaccttgatctgagaccacatcagcctagactttattgtccatatcactataagcattttggtcaaagccattcaacaaatctctaggaagttccaaactttcccacatcttcctgttttctgagccattcaagtctctagaaagttccaaactttcccacattttcctgtcttcttttgagctctccaaactgttcaaacctctgcctgtaacccagttctaaagttgcttccacattttggggtatctttacagcagcacccagtctaccattaccaatttactgtattagccgattctcatgcttctaataaagacatacccaagactgggtaatttataaagaaaattaggtttaatggactcacagttccacgtggctgggaggcctctcaatcatggcagaaggtgaacgaggaataacgcactctcacgtggcggcagacaataaagcatgtgccagggaactgccctttataaaaccatcagatctcatgagacttaatcactatggcaagaacagcatgggaaaaactcgccctcatgattcaattacctcccactgggttcctcccatgacatatggggattatgggagctaaaattcaagatgagattggggtggggacacagcaaaaccatatcactgaccatccctcctaatgtgtgttttctaaaccgaagatttagaattcgtagttctgaacattctatatctattaagacagtttaatattaatgaaattctttagccatttcattacactcttgattaatttcatacctataaacaaaataacttgttcttttcagattattaatcatccatagtcaaagcatttttataatagcttcaaaacattttttcatgcctgaaggtactataaatttatggaaagtataatactgtgtgggtaaataaaattctatatgcagtgcaaatagagccttaatttctccctatcagggaatatcaaccccaaaataccggaagtagaatgttccaaagataaacaagttgaagctacatgttatagacaggtagggactatgatgtgtttttttcataggcctcattgtgtctgcttccatgaacatgaatcagtactagcaatcaggcatgtattgaagacttgttctgccgaagtcccagagagtatgccatctggccttaaatgaagtgaaagtacatcaaataaagatacttccttgggcaactgggatttaagatgtatatgcaggacatgactaagtcaaccatctactttttctcaggaagtaaatggcttgccaatgccacaggaaagtctaaagcgttcacactccataagcgtgtcccatgtcctgttgtgtgtctggacaggagctggacaaaggccctgttactacttctagcttaccaagtcttagctgccttggaggaagacagcgaatctggcttatccagaggagaggcctgaactgtgaatggggtacctacctggtgtgactgatttctcttttatgtatctgtcttgggcttccagctaaattgtgaattcaccttgcattgtcttcctacacacacacacaaacatttatggtggatgttgaagacaatgtcagtttttcagcaagtctgaatgtgaaacaaatgactatgtttcttggtgcagtggggtgtgaggatgagagacaggaaaccaacctgtgatataaactgacatctgagcctaccaaaagccctttgagagacctttgatcaagacaaagggataatcatagccttgtgcacttagatgaaattgtccatgctattcctgtatgtgtgtgtgtgcgtgtgtgtgtatgtgtgtgtttcttcactttatccccagcattatggtctcaattcatatacatttgcttttttctttattctattctgatataaaggaaagaaataatcaatgattcatttcctttttttaacatttcaaaaatttatttcattattccctacctcccagtcctcaccccccaaaattacaattacgatagacccattggcaagtacttggacatgcaattttcaaaccaaaggtttactttgctataagaaacatctaagttaggatgttataatatgaaataatagcaaattagatgtcaagaaacctgggtcctctccaagctctgcctttaatgggctttgcatttttttgcaaactatttaaccttcctgggcttcatatttcttatatgttaaaaacaaacaagcaaaaaggaggagtaaacaaaatgaccccttagaattctcttcagggttatggtttgaatgcatttaattatcgaatttctctcttcttttaaatgtaagcatcaagaaaatatttgcctattttattctctcatcattaatttttaatcaattaaataaagtagatgaaaattttatcaaaaccatgtttcttgctttcattctaaaacaatgcaactcaccactatctgattcagaaagtctttctgaaatagtgtttttttcttttgttgttgttttttctttgtgctaaagaaaattcattgatgagtaccaagttcttaaaagaaggatggaaaagtcattgttgtttagtctcaacttctttcttcagtgcttcctcctacctcttaaataggcaaataaagccttaggccaggcactaattttgcttagtaatgattcataagaaggtagtgattttgtcagaaattgctgggctgcatgcttttaatcagcgtctaaacttaccttgaaatactccattccaaaatcagcagataatttcttctagagagtctttcaaactctagtgtcaaacagatgtgtttactgttttgattagggcttatttcttttgttgttgataagacttcagccagttttctttagactaatattattatattcccaatgaattatactcttaggttgtgaatttgtttaaagataaatctatctccagctggctggcttccaagtaaaaagggtatcctagggaagaagtgcacttcacagggattcagtacaggtgtagagaattccctgatagagaattggaacacatcaagagtttgcaaattgaaaaggtacttttatgtgcttatccatggtggacaacccgtgtcctagggaagaagcgcatttcacagggattcagcacaggtgtagagaattccctgatagggaactggaacacatcacgattttgcaaactgagcaagtacttttatgtacttatccatggttgacaacctactgtgctagacatttgctgtagtaactccttgattttttcctcagttgtttataaaattaaacagttgaagtagcctattgaaaactcttaaaagaggcctctcttatattcctttagaatacagtatattaaacaagtgataaagtccaaagaaaaatccttattcttttcttgctttaaaaaatgcactttattgtattaagcattatatctatcttttaaaactttgaattgccatatcaatgaaagtagagtgttatcattacaaaacagaatcgcagacagtgcttattgaaagaaaagatgcataattgatgctgtaaatgctcatcttgaatttgatgatggctggtgagaaacctcagtcggacattcaattttgattgccattggtaagaaaggcagcctttgttctttgtcattatgtggcacatgatcctaattcaccctatcagctgcttctctgcacactttcaagctatgtgattgttatactagaaagcatctaaattggccaaactaatgaagactaatctgacaaagcacgtgtgaatgataaattgtgaaaagaccctgaaaatagagcctcttcagtggcttcttcccctaagggtagaagataccagaatccctgggcaagatgaaatagataaaggaacgacatcatttttatacccagcaaatcagaaatattaaagaaagagaagcaagaatgaagaactactactttcatagttcattcttgcagtgtagcaccttatttcccatagagacattggcgaaaccatgttttgcgttgccatagaataggtgttcagtaaatattttccagatggccttaatatgtagtaaaacagagagaaatacggaagcattgacaagaagtttgtggataatttgagggcaaaaggatgtggataggatcaggttcataatgcaaatttgctattattctccttagattaatgatgtcacccaaacttcacgacctgctttccaaggtatatgctgttcacagccttggaaacatttagaagtttttaatacttggagcaagatggatatatgtttcacattttatctaggacttagtaggacttgggagacatatctactttgccagatcttagtatacttattacggagcatgacattttaattctctttgcttttgtcctataaagtttagtgttttatttttctcagtgcatatagggagtgaattatttatataatctgaaaagtactttgaaaactacttgggaagagatgttgaataaataagttgttttttttttttaaattagcctacaggatgtaagtctggccaggctagtggtatttttggtatcattgtgaaaaatcaaaaacagaacatgcatttatcaatccattagtgtgttctcaggaatgtgctagacactagggaatataaaagtagtataaaacatgactcttgactttaggaccaagcattaaagccagaaggcaacactattaatgtaaattcatggtgtgattatggaacagtttatgactgtacaacttaatgaaaagttcattacagactaaaaatactacatttatttagagagaaggaaaatctgttcagattgaaggatttgaagagtggccttcatgggcaacatggctcctgagccaggacttaagatatggtttttttttttttttttttttgataggttagaagggttggagaggtttcatgcaaggggttaggaactgaggaccaggaggcgtatcttgagctcactgggtttactgataacagggagcaggcagagagtaccaggctgtagatttgttttccattggaagctcttcccatttcttattatggttgctgcatgtaggcttatcccttgggtagggctattggaatggccaccctgagcctattgcttattggatagtggtggcttctgtgtgatatttcagcacatttctcttttctgaacattatgtaaattcaatcgtaaaactactttcttaaacaatgttccaagaggcctattaaagatgccaacaatatgacttccattcaagaatacgatcttgaatgggctttacaatggcagagctgacctgagattacctcctgtactcctgctctcaagccatatgctgatgctgactgtcctggtccaatagagccataaggcctcatagaacttgagatcatctaccagtggctttcaaccaagccactgcctttctgctaggtagtgcatagggacattgggaaatacagttattacaagaactggaaagagttgtaggcttttggtgcctaaagtcagaaatgctaaatttctgtggtgccaggggcagtcctatataagaaattattatgccacctcaaatgccagtagatccctattcaaatatttgagtctcatgtcctcactttatttataggtgaggaaatgggaggtcctgagaagtgacacaactttcttctaggattaaacttcacagtgtcagtgacagatttataactcaattcttttaattttctttcaagagctcttgttgcagcaccacagtccctcctattaacatgggctataactatggaatagcatgttgtttatctctgtcatttttatggaaggatgatagttagctgtgttaactatctgaatgggtgcaatgtgcatagagataactggtacttgaccagcagttctttcccctgggaacacacacagattcacctgtaaattagggttggcagatgcctgttgagatgtcagccacagccaaagcttacagataggctgactttctggaaagggcatggagtaggctttggattcacacaaatctgcttgtctgacaggatttgaatacaactcttcttatctttactatctttgtgactctcaaccaattaaactctctgagctttagctgcaaaagaacaggtgatgattcttatttcacaaggaatgagtcaaaacagttcctggcacatattgggcactgcagatatagagaattccctacagtatctttttgagagtaaagacttgaaaccttcacttataaaagatcctcctgataacagttgctatttttttctcctcctttccccaaacaaccaagggctttaatgagtccctgaagtgtttattttgtttaaactgttgagatttccctccttcagaagagtcctgctggccagagatgagtttcttttgactcctctgtcaatgtccctgtattattgtcatatagtaaaaatggaagatttatctagatggttattagcaggttatgaaacttagattttaaagtcaagaataaaagccattcctgggtagagatgtttttcagagagattgctaccttgccagcgatgagagagcctccttaggtgaggtgaatacttttggcaagttaaaggataacacaatataatttatttaagtaagttttttatttgggactaatttcaggtttgcagaaaagttgcaaaaattgtagaggtcctgtatgttcctcacctagtttcctatgttaacatccataatcatgatgtatttgtcaaaactaagaaaccaacattagtacaatgctattaactaaaatccagacttcatcctaactcccccagggcttccactcacatcgttttttctgttccaggattaaatccataagagtgcactgcttttgattttatgattttttaaatactgtgcatatactttttttatttgggccctctcacatgttaaactaactggcctttgtaaccagatagcaaattctataacagaaaatacaatgatgttgaatccagcatcatgctggacacaaagtatgttctctaaactaattaaatttatcacagcaacaagaagaacaaaattttactcagtgtacatatgtgtagctgagtcctcattggtaagctaagaggtactcataagagtgggatgacttggaaaaaatttgattttgaatgtgtgccctgaacattggtgtaaagcaggaccccctaaatcaacattaactgagtctgtacaatgtgcctagcatagtgtgtgcatatcacacttactcctgataactgtaaggcacatagccttgagtaacttagctgaggaaatgagaccaagggaagttaagttacttgcccagggattcacagctagtaacaaaactgagattaacacatgtttttctggcttcagaacctacactcctaatgtggtattcaattactcccacacttctccacttgcttaatccctattcttggtgtcctttttctaggtatacagaatttgaaaactctatattgtcaaactgcagccaacctggatacacggtatatacttttttgtgagctggattaagtttcagccttgaatttgtggattattttcaaaacctacctaacatctgtaaaacatgttattttttaatatgtagatatccacgtaaattgaccacaaagctcttcagaaggtcccataaaccaataattaataaaattttgagacatggctaataacaggcacagaagcatctgcaaagggcaggacattgatattgtataataatttaaagtattttattattgtataatgtgcctgagttttggataattgaccttcatttctcagtctttacatagttactgcttttttaagtgtcacatgagggatgtggaatattcagtgaaacatttgactaatctttatattttgagtggcccaactgaaaattacccttggttgccttggaactctgggaatgatattcaaaagtagaaattcttgcaaattatttgagctttggctctgggaagataaacaacatgaataactaggttaaccagagctgaaatttctctaacctataattctaaattcagaaaagaatgggctttagggttttttgtttatttttgctttgattacaagttgttggaagcctagagttagtatctaataacacaatctatgtaaaacacaaattattggctcagaatgatatctaatttctaagaagatacaagaaggcaatcacgtaaaaacgtgcttttcttcatagaaagaataagctgggattggccaaaaggtaatccctttagagtctaaggtttagagcattgcatatttttaaagaagatatattaccttttagaacatacataagaaaccattttctttgcttatatggctacataaagttgtcatggttttaaactgtgaccttagatcccttatagaagtaattacaggcacaatctgtgaatgaagatttgcaaactatgcttcaccaagcctcagggactattggatgtccagaggacagagccatgttggatgtcttatgggccttcagtcctgcaaagcagtgtgctttcatgttttatacgcagcagttctgagaaaatttaagttgacaaaacagcctctcttcttattatttttatttatttatttattttgagatggagtgttgctctgtcgccagtctggagtgcagtggcatgatcttggctcactgcgacctctgcctcccgggttcaagcgattctcctgcctctgcctcctgagtaggtggagctataggtacaggccaccatgccctgctaatttttgtatttttagtagatacagagtttcaccatgttggccaggatggtctcgatctcttgacctcgtgatctgcctgcctcagcctcccaaagtgctaggattacaggcgtgagccacggcacctggtgcaccagcctatttttattttttaaagacctgagtgcagtggtgcaatcttggctcattgcaacctccacctcctgggctcaagtgatcttcttacctcagcctcccaattagctgggactacaggtgcatgccaccacacccagctaatttttgtgtgtgtgtgtatatatacacacatatatatatatataaatagagacagggtttagccaggttgtccaggctgatcttgaagtcctgagctcaagtgatctgcccacctcagcctgtccgagttctgagattacaggtgtgaggcaccatgccgagccatcctctcttctaataaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctaaattcaggcttacttttgtaactgctagattataaactcttagagggcaaagggctttgtattctctacttgtgtacactcggttagtttgcttaagcagttacttctgtgtaagcaacattaatgaagtgcttactatgatcaagggctataccaagtccttttttatattgtttaatcccacacaaaacccatgatcgacctaattctacacttggtgaaactatgatgtagggaggttaaataatttgttcaaggacccacagctggtaagtcgcacagtttattcaaacccagatcttcctaattgcaaatgtgtccaactcccatgcttctaaccactgcctatgtggtagttctttgatattcctccctctaagaagtggagtttaattcccctgctccattgaatgtgggccgaactcaggtgactcatttctgttaagtggagtaaagtggaagtgaaaatgtgtggctttagcgactaggtcattcaaagacattcaaagtggtttctgtcttggttgttctgtctcatacctattgggcatttaatctggggaaaatttaatctggggaaaatttaatctggggaaaactgccatgttttgagctgtttatggagaggctaagatgaaaaggtactgtggatccaacaggcagtttcaaatgaggacctgaggccctcagaccgacagccagtgtgaaactgaagcctcttgaccacagcctccatgagagtaaaagaatcttgaccccctagtgaaccacagcctccatgagagtaagcttcaaaacagagccttaacacctagtggagcctcgagatgactgcagtcttccaccaacagcttgattcatgaaagaccatcagccagagccatccagctaagctgcttctaggcccctactcctagaaaataactgtttgttgttttgactgccaagtgttcagttcctttgttatgcagcaatagataagtaatgcagcctaacactgtccttatcattttttaaaaaagaaattgttttaattttactaaatcacaaattttaaagcattgatacagcaaggagaaactttccagaaaaaaatgctgccaaatttaaatagtaaaatattaatgtccaaaaaacataatagttacaatgacatctaggattgaggattttgtaagtcaaaggtcagccacttaaaaaattcataattttaaaaggaaggatattaataataactgcattattgaacatagatagcattttgaacttttaagaaatcctcatgggaaaactcaggaaatattgtttggtaagttatcactcataatcttaaattgttaggcgcatgtttgcactttccatgattgaaagaggaatgtaaagcaaagttgaattttaacctcttccctagtgattttactcagcttttcaaaggggtcctgaaagctcagaggtcaagtcatttcttggtttgctctgcctgacaaattgcattaactctgttttatagccactttcagtttaataaatgacttggactttgattaatatctttagtgcttaagcccaagaatttgtataagactttgggatatagtactgtaaatttatctaaagatggacactggaaggtagaaggagatatattagtgttggtttgggtacatgtctaggtactgaatttggatcatcataagtccttacagaagatacttgttgatttgtcttttaaaaaaaaagtgaaagtgattttttaatatatttacaaagtgatttaagtgatttaaggaattcattcatgaagtggatatggctagttcttgtttagtattcagaatgactgtaaaatagaaatgctgattttccttgcccagattgtagaacacagatcaaaccctcctagtccttcccttaaatgttttttctccatgcagcttacaccctgaattctcaaaacatttgttatattgaactggactggatagtatatgcctgaccctgattcatgggattatgctgcaagggaatataaagatgaatattgatagcctgagtgtgaaaattcataattactctcatcctcgttcattaattcatttgttcattaactcataaacagactaattgattcaacagatatttattgaacatttacactttgcccagcagagcactggactaggtgctagcacagtataataagcaacccagaaatagcctctgccctgctggatttcatagtctaagatggagaaaggcattaaccaagtgtaatttaaaatcgttttaagtaatgtgaaataaatatatatgagaacctgactcaggttgggatttgatgattagggaaagctttcaaaaaagggatatttgagatctaaataagagggagaagaaagagacaatggctagagaaaaaataggatccaggaagatacttagtacttctgagaactaaaaacagccaagtcagtgtagtcagagttcaaagagggagaaagtacatatctaagaagaagctagaaaagtaagaagggactacgtcttacacaatgatgtaggctgtattttagtttttacttatcttaagagcaatagaagaccattgaagggtttgaagcagggagtgacataatcaggtctgcattttaagttcacctgctctgttatgaagcatgactggaggaggatggaaagagatattcagggagctggattataagtctgttgtaggccagaggtattggtagcttggaccggggtgatgatgctgaagattgaaaggagttaatatatttataatatatttgtgaagtaaagttgactgtacttagtgctgacttagatagtattggtgagggatgtcatggtaaattccaaggtattgggcttcttcaactgaatgggaaacactagagggagagcaggtaaaagttgagggaaagtgagggacagtagttcattttggggatattttgatttcgatgcctttttaagacatcctcaaggagacacagtgcagtcttgagtcttggatcagaggagatacctgaatgtataaatttgtaagacagtggtttatgcacactattgaagccacagaggtaaatcagatgatgtacagagtgcaaatgaagtgagagaagaaagcataagtctgagccatgagaactctaacatttaaaggccaagtggaaaagttgacaagagtgggaattgtgactagggtagatgccagagtggcatctcagaggccaaggaaagagaatcatttaaggtgctgatgaggggtaaagtaagaaggtcctgtaaatgtccccttggattaataaaattgatgttttgaaagactttaaggagagtgagtttgttgtagtgatggggacagaagccagaatgaaatgtcatgggaaatgggtgggaagtcttgaaagagagacaatgaatataggtaattcaagatatgtggtcaagggaaacaaaaaggataaggctttaactagaggaggaaatagagttaaaggaggaggctttttgtttttgttttgttttgttttgttttgtttttgagatggagtctcactttgtcgctcacgctggagtgcagtggcgcgatctcggctgactgcaagctccacctcccaggttcacgccattctcttgcctcagactcccgagtagctgggactacaggtgcctgccaccatacccggttacttttttatatttgtagtagaaacggggtttcaccatgttagccaggatggtcttgatctcctgaccttgtgatctgcccgccttggcctcccaaagtgctgggattacaggcgtgagccactgcgcccggccaggagttcttttttttttttttttttaaagatgggagaattgagcacatttaaacactaatggggaagaccagtggggaggatcaggggtggcctgaagatagacagagggtggataaataatcatataggattcctgagaagatagaagaagttggatccagagcacagcagggggaattagttggccttggagaggagagatgatctctaccctctgttctagaagaaagccaaaggtgatgtgtgcagatgcagaggtgtgtttgatgtggtggaggcaagtcaaaggagtttttgttcgatgccttatacctgctccagaaagcagttgagtcaccaactgagagagggagagagaaaggggctagcatactgggaaagaaaggggatcatttcagatatttgaggaggacagagaaagtttgaatatgaaagggagtaaatgagtaaaatttagtaggatttctagtcattttttgaaagctcagctgaggctgatgatcatgaattcatggtgataccattgttagaattattataaaatatataataatatattatatattcacctccttttggaggtgctcagcagtttactagacagaaaagcagggtcatctaggcttaaaattttgtcagagaggtatgatgaaaagattgcaaaggagattaggatattggcatgggcaagggagcttctagagtgataaaccaggaatctaagcctgctagtgggggacatgtagacaggagaaggagagtataaagatctttgtgaaggctggaggaaatttgtaatcagagtggttgattaaacaagacagaagtatagcagtcagtgatcagcacaggatgctgcaccccagatcaattaaatctgtatctctgcatacagggcccatttcagcttctcaggagatcccagtgctttccttaagggagaatattgatataactgttattaagacttgtgaaaaagatattagcaatgtgaaatcaagacaaaaacacaaacacagaaagaagttagacaaaaaaaaccaacaacacagaaattacacattttctttttcacaaatcaaagtcgaattcatgggccttcctccctggctcattctccctgacattagaagtacaaagggagtaagtaaagtctttatggggaagatggtataattaagcaacaattacctagggaccagatgcttttgaatttgactgatggaaacagaagcgtggtgaatttgttcactacagtctttttggaggggcaacactcttggctcacttggcatgaggtagtttcagtctggctacaaagatttgaatgtgggacttgagtttctaaaaggggactaactggccttctgttagccaggattctcggacttggtggctatatcacggcttatgctgtcttggaatggtcttgggcccagttgaaatttcttgaaattacatatgaagattcattaatgtattacttggaattcagtgacaaggatcatcattgccaggtttcctagttaggaaaacttacctccattccttccagttaaatagaagaccattgtatagttcatttctggttaagtagagtatttatgaaatgtgtagggcttataggcataactattgctaaagaaagcccagtaaagcttgacattccctctgttgcccttgtctgtctttccataaatttaatgtcaagagcattttttgagaagatgatcacaggatgattcaggtagacatggagcaggttgtgaaaacacttgaatgtttcaccaatgcattagggtttccagagaaacagaaccagtaggggtgtgtgtgtgtgtgtgtgtagatttattttaagacattggctcacacaattgtggagactggcaagttcaaaatgtgcaaggtgggccagtaggttggagacccagagaagagctcatgttgcaggtcaagtccaagtctgctgcagaacttccctttgcttggtaggtcagtctttggctctattaaggcattcaactgattggagggcagtttactttactcagagtacatcatttaaaattttaatgtcatctaagaacactctcatagaaacatttaggatattatttctgaggactctgttctgttccattggtctatatctctgttttggtaccagtatcatgctgttttggttactgtagccttgtagtatagtttgaagtcaggtagcgtgatgcctccagctttgttcttttgacttaggattgtcttggagatgcgggctcttttttggttccatatgaactttaaagcagttttttccaattctgtgaagaaactcattgggagcttgatggggatggcattgaatctataaattaccttgggcagtatggccattttcacgatattgattcttcctatccatgagcatggtatgttcttccatttgtttgtgtcctcttttatttcactgagcagcggtttgtagttctccttgaagaggtcctttacatcccttgtaagttggattcctaggtattttattctctttgaagcaattgtgaatggaagttcattcctgatttggctctctgtttgtctgttactggtgtataagaatgcttgtgatttttgcacattaattttgtatcctgagactttgctgaagttgcttatcagcttaaggagattttgggctgagacaatggggttttctaaatatacaatcatgtcatctgcaaacagggacaatttgacttcttcttttcctaactgaatacccttgatttctttctcttgcctaattgccctagccagaacttccaacactgtgttgaataggagtggtgagagagggcatccctgtcttgtgccagttttcaaagggaatttttccagtttttgcccattcagtatgatattggctgtgggtttgtcataaatagctcttattattttgaggtacattccatcaatagcgaatttattgagcgtttttagcatgaagggctgttgaattttgtcaaaagccttttctgcatcaattgagataatcatgtggttcttgtctttggttctgtttatatgctggattatgtttattgatttgcgaatgttgaaccagccttgcatcccagggatgaagcccacttgatcatggtggataagctttttgatgtgttgctgaatccggttttccagtattttattgaggatttttgcatcgatgttcatcagggatattggtctaaaattctctttttttgttgtgtctctgccaggctttggtatcaggatgatgttggcctcataaaatgagttagggaggattccctctttttctattgattggaatagtttcagaaggaatggtaccaactcctccttgtacctctggtagaattcagctgtgaatccatctggtcctggactttttttggttggtaggctattaattattgcctcaatttcagagcctgctattggtctattcagggattcaacttcttcctggtttagtcttagaagagtgtaagtgtccaggaaattatccatttcttctagattttccagtttttttgcgtagaggtgtttatagtattctctgatggtagtttgtatttctgtggggtcggtggtgatatcccctttatcatttttaattgcgtcgatttgattcttctctcttttcttctttattagtcttgctagtggtctgtcaattttgttgatcttttcaaaaaaccaactcctggattcattgattttttggagagttttttgtgtctctatctccttcacttctgctctgatcttagttatttcttgccttctgctagctttcgaatgtgtttgctcttgcttctctagttcttttaattgcgatgttagagtgtcaattttagatctttcctgctttctcttgtgggcatttagtgctataaatttccctctacacactgctttaaatgtgtcccagagattctggtatgttgtatctttgttctcattggtttcaaagaacatctttatttctgccttcatttcgttatgtacccagtagtcattcaggagcaggttgttcagtttccatgtagttgagcggttttgattgagtttcttggtcctgagttctagtttgattgcactgagagacagtttgttataatttctgttcttgtacatttgctgaggagtgctttacttccaattacgtagtcgattttggagtaagtacgatgtggtgctgagaagaatgtatattctgttgatttggggtggagagttctatagatgtctattaggtctgcttgctgcagagatgagttcaattcctggatatccttgttaactttctgtctcgttgatctgtctaatgttgacagtggagtgttgaagtctcccattattattgtgtgggagtctaagtctctttgtaagtctctaaggacttgctttatgaatctgggtgctcctgtattgggtgcatatatatttaggatagttagctcttcctgttgaattgatccctttaccattatgtaatggccttctttgtctcttttgatctttgatggtttaaagtctgttttatcagagactagtattgcaacccccgcttttttttgttctccatttgcttggtaaatcttcctccatccctttattttgagcctatgtatgtctctgcgtgtnnnnnnnnnnnnnnnnnnnntggtaatcttcctccatcccttatttgagcctagtagtctctgcgtggagatggtctcctgatacagcagactgatggtctggactcttatccagtttgccagtctgttctttaaattggagcatttagtccatttacatttaaggttaatattgttatgtgtgaacttgatcctgccattatgatattatctggttattttgctcgttagttgatgcagttccttcctagcctcgatggtctttacattttggcatgtttttgcaatggctggtaccagttgttcctttccatgtttagtgcttccttcagggtctcttgtaaggcaggcctagtggtgacaaaatctctaagcatttgcttatctgtaaaggattttatttctccttcacttatgaaacttagtttggctggatatgaaattctgggttgaaaattcttttctttaagaatgttgaatattggcccccactctcttctggcttggagagtttctgccgagagatctgctgttagtctgatgggcttccctttgtggataacccgacctttctctctggctgcccttaagattttttccttcatttcaactttggtgaatctggcaattatgtgtcttggagttgctcttctcgaggagtatctttgtggcgttctctgtatttcctggatttgaatgttggcctgccctactaggttggggaagttctcctggatgatatcctgaagagtgttttccaacttggttccattttccccctcactttcaggcaccccaatcagacgtagatttggtctttttacataatcccatacttcttgcatgctttgttcatttctttttcttcttttttcttttggtttctcttctcgcttcatttcattcatttcatcctcaatcgcagatactctttcttccagttgatcgagtcggttactgaagcttgtgcatttgtcacgtatttctcgtgtcatggttttcatctctttcatttcgtttatgaccttctctgcattaattactctagtcatcaattcttccacttttttttcaagatttttagtttctttgcgctgggtacataattcctcctttagctctgagaaatttgatggactgaagccttcttctctcatctcgtcaaagtcattctccgtccagctttgatccgttgctggcaatgagctgcgctcctttgccgggggagatgcgctcttattttttgaatttccagcttttctgccctgctttttccccatctttgtggttttatctgcctctggtctttgatgatggtgatgtactgatggggttttggtgtaggtgtccttcctgtttgatagttttccttctaacagtcaggaccctcagctgtaggtctgttggagattgcttgaggtccactccagaccctgtttgcctgggtatcagcagcagaggctgcagaagatagaatatttctgaacagcgagtgtacctgtctgattcttgctttggaagcttcctctcaggggtgtactccaccctgtgaggtgtggggtgtcagactgcccctagtgggggatgtctcccagttaggctactcaggggtcaggggcccacttgagcagggagtctgtcccttctcagatctcaacctccgtgttgggagatccactgctctcttcaaagctgtcaaacagagtcgtttgcgtctgctgaggtttcggctgtgtttgttattgtttactgtgccctgtcctcagaggtggattctacagagacaggcaggtttccttgagctgctgtgagctccacccagttcgagcttcccagcagctttgtttacctacttaagcctcagcaatggcaggcgcccctcccccagcctcgctgctgccttgccggtagatcacagactgctgtgctagcaatgagggaggctccgtgggcgtgggaccctcccggccaggtgtgggatatgatctcctggtgtgcctgtttgcttaaagcgcagtattggggtgggagttacccgattttccaggtgttgtgtgtctcagttcccctggctaggaaaagggattcccttcccccttgcgcttcccaggtgaggcaatgcctcgccctgcttcagctctcactggtcgggctgcagcagctgaccagcaccgatcgtccggcactccccagtgagatgaacccagtacctcagttgaaaatgcagaaatcaccggtcttctgtgtcgctggcgctgggagttggagactggagctgttcctattcggccatcttgctccgcccccccttgttgaggttttttatcataaaagtatgctgaattttgtcaaacgctttttctgtgtctagtgaggtgatcatgtgatttttgtttttaattctgtttgtgtggtatatcacatttattgactcaggtatggtaaacctacatccctggtatgaaaccactacctccctggtatgaaacccacttgatcatgatgtattatcttttttgaaatgctgctggattcagttagctacaactttgttgaggatttttgcaggtatgttcattagggatatttgtctgtacttttagttttttgttatgtcctttcctggtttagatattagggtgatactggcttcatagaatgatttagtgagcatttcctccttttctatctttttgaatagtttcagtattcaatttttctttaaatgtcagatagaattcagctgtgaatccatctgctcttgggctttttttcttggcactttttttttattactctttcagcctcactacttgttatttgtctgttcagagttcctgtttcttcctgatttagtggaggagggttgtaaatttgcaggaatttgtccatctcctctagattttctagtttgtgtgcatataggtgttcataataaccttgaatgatcttttgtatttctgtgatatcggttgcaatatcttgtttcatttcttactgagcttattcagatcttctctcctcttgtttaatttcactaatggtttttcagtcaattttgtttatcttttcaaagaaccagctttttgtttcacttatcgtttgtatttttgttgttattgctgctgctgttgtttctgtttcatttagttcttctcttatttggttatatcttttcttctgctgggtttgggtttttttttttttttttttttcttgtttccctcgtaccttgaggtgtgaccttagattgtctatttgtgctctttcagactttttgatataggcatttaaaactatgaaatttcctcttagcacaacttttgttgtatcccttaggttttgataagttttgtcaccactatcattttgaaagaatttttaatttccatcttgatttcattgttgacccaaagtcattcaggagcagattatttaatttccaggtatttgtatagttttgaaggtttcttttgggattaattttcatttttattccacagttgtctgacaggatacttaatatgattttgattttcttaaattcattgagactcattttgtggccatggtctgtcttggagagtgttccatgtgctgatgaaaagaatgtatattctacatttttaggtagactgttctgtaagtacctgtaaagtcaatttgttccagggcatagtttaagtccattgcttctttgttgactttctgtcttgatgacatgtctagtactgtcaatggagtaccaaaatcccacactattattatgttactgtctatcttgtttcttaggtctagtagtaattgttttattaatttgggagctccagtgttagatgcatatatatttatgattgtgatattttcctgttggactaatccttttatcattatataatgttcctctttgtctttttttttttttttcactgttgttgctttaaagtctgttttgtctgatataagaatagctactcctagactgggcgcagtggctcacacctgtaatcccagcactttgggaggccgagacaggcagatcacaaggtcaggagttctactaaaaatacaaataaattagccaggtgtggtagtgtgcacctgtagtcccaggtactcaagaggctgacgcaggagaatcgcttgaatccaggaggtggaggttgtagtaagcaagattgtgccactgactccaacctgagcaacagagtgagactccttaaaaaaaaaaaaaaaaaaaaagggctactcctgctcacttttagtttccatttgtgtggaatatctttttccacctctttaccttaagtttatgtgagtttttatgtgctatgtgggtctcttgacaacagcagatacttggttgttgcatttctctccattctgtcattctgtatcttttaagtggagcatttaggccatttgctttcaatgttagtattgacatataaggtactgttctattcattatgttagctgttgcctaaatactttttaaaattatgttattgctttataggccctgtgagatttatgctttaagaagcttttgtttgagtgtatttcaaggtttcgtttcaagatttagaactcctttaagcagttcttgtagtgctgatttggtagtggcaaattcccttaacatttgttaggctgaaaaatactttatctctctttcatttctgaagcttcgttttgctggatgcaaaatttttgactgacaattattttgtttaaatatttctcaaggtttctcttgagataacctgatgactgagtgtctaggtgattatctttgcagtgaatttcccaaaagttctttgagcttcctgtatgtggatatcaagatctccagcaaggccagggaagttttccttaatattcccttaaataagtttttctaacttttagattttacttcttcctcaggaacaccatttattcttaggtttgatcatttaatataatcccaaattttgtggaagctttgttcattttttaaaattcttttttctttgtctgattgggttaattcaaaagtcttatctttgagctctgaagttctttcttcgtgttctagtttgttgctgaaactttccactgatttttgtacttccctaagtgtgtctttcatttccagaagttgtgaatgtttttctttatgatatctatttctttggaaaaaaatgcgttcatattctgtattggtttttaaatttatttaattttttttttttgccttttactggtaactccttgagtagcttaataactgacctgctgaattctttgtctggaaattcagagatttcttcttggtttggatccattgttgtggaactacagtagtctttgggggttttatagaaccctgttttgtgatattaccagaattacttttctggcttcttctcatttgggtagactattacttaacattgttcttgtggactgtttttttttttttaaatttcttattttttctttgttaaggatcagactctaatgtttattttagcctaattttagtcttggtgcttgtaggggtgaagactctgtatgagatccttagttatagagtctttatgcactggttttccccagtgctggttttagtagttccattcttgatatgtgggtgaattcactgtctcctgtgaagttggaatggcagggatcccttgacgcttatgtcgtcctctcatggtatacagtttatttactgttcttttatttactgagttgatgattcaggcttcaggacaactggggaggtatccccgggcaggcaccagctgtggctaaggcaagtgggtagatgtaatacccagtgatgagccgaggacacagccttaatgagggtggctggaggagctctcagttaggtgtgctgaaattttatcaaggtgaagagtgggagctacctcacctcccctgccaggtcagaaagaaagctattcacctcacagcctcactcctgtccaagcatttcagctattcagatcagtcaggcacctcttttcatctataggaatgttgttgctccaagtagggaggaattgtgactctgcctctcatgcaggcctgaatctggggtgtgctcttcttgtgggttatactcaccttggagagttccagaaaggctgtctacaggtgtgtccttgctgcattcctgtggaggaagccccagctatgtctgcggtggagtgccagggggaacaaagactccttttccaaggcccttcatggtcacagaggctgcctgcttgttggggtagaggtgcagactttccctactgcacccagcactgcaattgggtctctgctgtgagaaactacccaccagcagaaagatctgaaactcctactattcagattattttgtcccacatagtgattccttgatgtggtgctctcccctttccactagagatgggcttccggagagccagattgcagtgactgttattgttcttctgggtttagccatccaatggagttaccaggctctgggctggtgctggtgaatgtctgcaaagagacccgtgatctgatcagtcttcaggtcttctagccatggataccagcacctgctgtggtgaaggtggcaggggagggatgtagaatctgtgagaatccctgattgtagataggtatagtgtgctgactttctcaaatgctagttatgctagtagtgaagttgtcatgtggacagactcaggacctctggttagccaggatgttgcaggcagtggtattagctgttgtcttctccttcctgggaacaatattattgtcatgagtatggcctgaattggttggcctccagccaggaggtggtgtcttttgtgtttggctgccaaggcagatagaaaaatgccatcaagtggggccaggatgagctgagactcttcttgggctaggcttgtcacagccactatgtaggatggggaggatggttttcaggccgatggggttatgttccagaggggattatgactgcctctgttgcacaaaatagttcaccagggaagtggagaatagccagtagtgaaaagcttcacccagctcccacacagttggtgagcccaatctcactttgcagtgctgtgttaacagcaccaagtttagatccaggcatcctgcttgtggaactcagtcttgctccaggccatatacttccccactgagaaagcaagcaaggctttcaggccacacccctccctgtctgcccataatggcaggagcctggttcctgtgctcatatctgctgcagttcccatccacccaccagattctgttcaagcaggttcacgcccactcaaaattatcacaaaattcagttggaggcttctttcaccttgtaccccctccctaattctgctggctgccttccccgagggcccctgtgatatatagtcaggaatggcttccctgggtttgagctggagactgggagtgcctacaagactctttctgctgctgcttctacttttgtatttcacaaggttccctaaatctgttccagctctaggtaaggttgagtccttctctcatgatttgcattttcagattccccagtgaggaggtgtgtttggaggcaggtttcccccacttacactttgggaactcattgctttttgcctctctcacagtttgcagcagcatgtcacttctttcaacggatctgtgaattctttccattttcttgatatgatcctgtggtggttcttggagaaaaggttcacagtataagtctccacacactgttctgtccatccaagtgggagatgtatgttagccttgtctcctatccgccatctttctgctgtcaaatccttctctttagatagctgacataccatcttttgtttcttctgacttggttctattcactgacattcctctctatcaagtggatttttgaactttcatggaaatttattccctatttatatggaaataattcccaatttatatgaaaagcttacaaagtgattcattaaccaagtatttactgaggtgctaaaattatacactaatgcaagagtggctggcaagtcctttgccttcatggggattacattctcttgtaaatgtcacatgatggccactagatttaggaataaaggactccagcatgaaacactgacacttctgctggagaaatattttacaaaccatatatattgaagcctaaactctggtttattggtaaaggagtagcactgatactagaattttgtgatcaatatgttgggataagaagtcagaagacttagatctgtgttctttttctcctgctggctataggttgttttaatctctgagctgcaatttcctcatctatagaataggttagaccagattagtggtcttcaactttggctgtatattagaatcatcttactcttgaacatttaaattagaaatttcaggccaggtgcagtggttcacgcctgtaatcctagtattttgggaggcagatatgggcggatcatgaggtcatgagatggagaacatcctggccaacatggtgaaaccccatctctactaaaaatacaaaaattagctgggcatggtggtgcacacctgtagtcctagctactcgggaggctgaggcaggagaatcgcttgaacctgggaggcggaggttgcagtgagccgagatcgtgccactgcactgcagcctggtgacagagcaagactccgtctcaaaataaataaataaatgaattaaaattaaaattagaaatttccctgggtgaggaggaaggcagaggtatttttaaagctctcaggtgatacaattctgttttaaggtaggactaaaaatcatgggactacgtcagaagttctaattagaaatctacaggttagttttctccgggcatgtgtatagtgcttaaatgtcttttaaatttgttaccaacatagagaaaaaaaagatttctagtttcccttgaaaaatggaaatattaggcaacagttgggcttatgtttctgagtggtaaaaattaaacaaagtaaacgagtctccatttcatttgttcctgttgccttcctggctcttgaaggcattgtcatttgtgaaaactaaactagatggtctttaaagtctccaattatttgaattgcttatttccacagccagaaaagagatggtaaacaaactatacctttatctataagctagttggtttgtgaaatcaaaagggacttaatctttgaatatggaaaaatcccagcttccagtggaagaggaactccatctcattaatagcaggactccacagactgctatagaatagacacccacctggggctaagagggagggaggcggaagaggacttaattcattttctggggatttttaatgaagctttcccctctttcattatttcttatttgggagcttgatcattagttgggatgtgactggctttccctagggagcaaaaaggagattagcagaggttttgctcgcttcttcctgtgatttactgtgggaagcctcccaggttcttcccttcgcttctctatgaccttcatctttatggtttcttgctgtgtctctctgagagcaagtacctgggtgaaaaaggctgagtgtgtggtttattggcaactgcctggcattggatttaagtgggtatatttgaattactagaattttacgttttataggttcaaaatatgcacttgaattttgtaggacctcttacccaaattgaataatcctttgtgccttgttaaattttaaacagtcacactatcaacattatgacatatggtatatatgatggcaataataaaaataacacttattgtccactttaatgtgctaacagtgttccaagtgatttgcataaatgtcaaatttgttccacacaattatcctatgaactaaatgttattgtttcctggtttataggtgaggaacacagaggctcaaagcagctatttggtttctcttatttcaaaattaggggaagtgagatacattaacctgtataaccagaccttgttaactgtttttggtaaattccaatgtgtattgattttcacaaagacaaagcacaccactgttatattaaatattaattttttcatagtccctcaaggtgcttactggctatattgttactgtcttttgatgttgtttatacatggtggattacagaattccatgaacatgaaaaatcttgactttatcctagcttattacctattcttaccccctgcaaagtaaaaagttcacaatagcattagtaagccaagcaaactacttattagccacatgaacttactagcctctctgcctccgtttccttgttgggaaaatggacaatacctaactcaactcataaggatatttctagaatcaggtgtaatatcaaataaaaatatatttcatttttcctagaagatacccatgtatatcttaggtactgatgcattcatagtgatgcaggacatacaatgtttattcttttccttagcaacaactatccatggagatttttccactttagagatttaattccattaaaggtttttagattgattggacaatgagaatgtttttgtctctctgaaactgaggctgaaagttgatttcattctcacacttgttcccagcaaaggctccttccatgctatcaccatctaactgctgccaggctcttttcagtgtagatggacaacacgatggattaatttctcttgctgaagtcatttctactcttcattgccgaaaggttgcttatttgtgtgctcagcttcttgaataagttggcacattcagtggatctccccttgtatagctcatactcacttgtcagtaaaagatttgttgtgtgcaggaagggagttggggggacaatagctcctgcctgctaagcaatctaaattatgagttgagcctttcattcattgctttatatgtggctgtatgcttgctattaactaatttttgctgtttatgggaaaaatagttgccttttgaaaagaaaaaactgaaaagaggcatccatattcttctcaggtcttagtccatgggtgagtgggtgtgtgcataaacatatctatatacatgtgcatggaaatatacatttatatacatgtggtatatgtgcatacttagtgtaactaatgctatatataattcatgtggcaaattcaataaggacaacagtaacaaaaaggccagggaatgtaatcttctcccctgaatacttcaggtgcccaagaaacttatttgtctttcatattgtggagtaaataaagttttattttaaagcaactttctcagatcttttaaaaaaatgtttttaggtacagggtcttgctctattgcccaggctagagtgcagtggcatgatcatgactcattgcagcctggaactcctgagctcaagtgatcctcctatctcagcctcccaagtagcagggactacaggtgcaagccactgtatctgtctaatttttttcatattttttggacatgggatctggctatgttgcccaggctggccttaaactcttggggtcaaacaatccttctgcttctgcctcccaagtacctgggattacaggcatgagccactcagatccctttgtgtggcacgtataaaaccaatattttaaaactcagagcaatcttttttaatccttggagtaaccttatgaagatagtaaataacaaatgctctgagatctataatctctactactttaaagatttatttaaaattttatgaatttttattttcataattagtattttatatagttatagtaaatggtattttataaatatataaatacattaatgtttttaaaatttattttggagttttatgttggcttcaagataatgttaagtcttttaagggttacttattaatacaattttcagcttttatttgttcaaactcaagtaatgaaaatttctgcttaaaggagaaggttttacttccagcctcttcaggattaacttgaaagaaaatgtcgttaaactaaaaaaactatacatattacaccaccaaatacctgctttctggcactaataaattagttttttgaatgcgtccaccttagtaatgaattatctgcttgcatatacttctgttttaaaggatagataccatttgttacctgtgtttcagtcacagatttttactaaactttgctccctggtataaaacacagaatgggaatttgcagtataattgtgaaaaaactccatttgtttcctatattaagagcctataagcaaggtagagatggttaactgaggaagttgaatgataacatccaagctaagagccagttcaagaatacaatcccattctcaatagccacagacagaataaaatacctaggaatacagctaatcaaggaggggaaagacctctacaacaataattataaaacgttgttcagagaaatcagagatggcacaaaaaaatagaaaaacattccatgctaatggataggaagaatcaatattgtgaaaatagccatactgcccaaagcaatttacagaatcagtgtatgtcaaactaccaatgacattctccacagaggcagacaaaaactgtttaaaaatttatactgaaccaaaggaaagctcaaatagccaaggcaacccaaagcaaaaacaacaaagctggtggcatcattttatctgacttcaaatcatactataaggctacagtaaccaaaacagcatgtcgctggcacaaaaacagacacatagacaaatgaaacagattagagagcccagaaataatgccacacacctacaacaatctgatctttgataaagctgacaaaaacaagaaatggggaaggactctctattcaataaatggggctgggaagctagctagccatatgcaggagattgaagctggacccctccttacaccatataaaaaaatcaacttgagatacattataaacttaaatgtaaaacctaaaactataaaaaaaaccctggaagataacctaggaaatgacattctcgacataggacctggcaaagatttcatgacaaagatgtcaaaagcaattgcaacaaaaacaaaaattgacaaatggaaagtaattaaactaaagagcttctgcacagcaaaagatctatcaacagagtaaacagcctacaggatgtgagaaaatatttgcaaactacacatctgacaaaagtctggtattcagaatccataacaaacttgaacaaatcaacaagcaaaaaacaacccaattaaaaagtgagcaaagaacattagtagacatttttcaaaggaagacatacatgtggccaacaagcagatgaaaaaatgctcagtatcactaatcattatggaaatgcaaatcaaaaccacaatgagataccatctcacaagtcagaatggctattatcaaaaaaaaaatgaaaagcagttgcttgtgaggttgtagagaaaagggaatgcttataaactgctggtgggaatgtaaattgttcagcaattgtgataaacagtttggtagtttctcaaagaactcaaagtagaattaccattagacccaacaatcccattattggacataaactcaaaggaatataaatcattttaccataaagacacatgcatatatattttcattgtggtactatgacagagacacaataacaaagacatagaatcaaactaaatgtccatcaatagtagactggataaagaaaacgtgatacatatataccatggaataccacgcaaccataaaaagaaatgagatcatgtcatttgcagcaacatggatgaagctggaggccattatcgtaagtggactaacacaggaacagaaaaccaaatacaacatgttctcatttataagtggaagctaaacattgagtacatatggaaacaagagaacagcagacactggggcctactcaagggtagagggagggaagagaatgaggattttaaaactacctattagatactatgcttattacctgagtggcaaaataatctgtacaccatacccctctgacatgccatttgcctatataacaaacctgcatagtactcctgaacttaaaagttaaaagaaaaaacgaaagattaatgagtgtgatactggaacaatattatgatgcaggacaattttttgtgtgtttgctagctgggcttgagatttgataagtaagtccgattatcctaatccactagtgatgatgttctaggctttgaaattcaaactactactactccactttgagagagactgcatgagaattggacccagcctggggctttagacaccatagttcaaatcttggctcttatcattttttagtcacgtgttgtgcactgaatgtttgtgtttcccagctccccaaattcataggttgaagccctaacctccaatgtggctgaatttgagattagggcctgtgaggagctggtaaaagttaaatgaagtcttaaggataggtcgccaatcctatagagttggtgctcttacaagaagaggaagagacaccagagtcctctctctttgctatatgaggacatggtgagaagtggccatctgcaagctcagaagagagccctcaccaggaacttaagtgtctggcaccttgatcttggacttcccaacctccagaactgtgagaaataatttttcgttgtttaaatcacccaaactgtagtattttgttatggcagcccaagccaactaatataccatgtaagcaggttacttaaatttactaaatacgtaagttacttaaaatttcccatcctggttctaactttactagctatcacttttactagctaacacattacattttcttcaacttgccacatgctttttttgtgagttttaaatgaaattgtttaagtactttgtttatcatgctgctgacctatagtaggcacttaaagttagtttccaggaagtttggaatggatcttacttatttatgcaaatggttgactctgatggtacttgttcctctctggaaagggttcaactctcattagaatagtcctatgactgcagtaattttgtatgttaaacttatatttttatctgcagaatgttaaatctgcaaacaccatccatcaacccaaaagcaaaaaggagtgtttcctaatagttaatagttggtaggttaataggaaatctagaaaaaaaaagtttaataatgaaggctatattaatacccagtctcatttgagtgcctgtcagtaaggaaatagttatctttcattgttaatcaatgaagaccaattggcataattagggctctggtgtgttttcttcaaatggtcttctaggacctaatttaatatcattcgagaggcttaaagaggatcccatgtttccaaatgtatcttagagtcctcagctgcccaacatcccaccattaatcatgctttgcagatgaaaaattgaaggctccttgtctctgaatatctgggatatgcttttattcctaggatgaacttctccttctttgccaataaggaagaaaaagggactgaggtgatttataagagcagttctagtgagtgaaatatgggtcctagcaaaggaggacacagctgccccttgtaatagtggagggaaggaaggaggcaggctggcagtactttgccctcctcaaccccaaaccctatctgtttaccacagtggaccttttttctgaactctgacctcattatttcattcattatccacataatattcatcaatgttctccaaggcttttagaataaatctttaacgtttctccaaaagtcacaaggtctgacacctgccttccattttccagcttcatatcataatcctcctttttggcagtggccacactgatcatcttccaggtccacaaactcagcatttgctcattgtgaaccccttacatcatgactgtcagcccaattgtcatttccttggggaggccttccctgaaccctgggagtggatcatattcccctatcatgtgctttcatagcaccatgaatgtctccttggtggcagtccccagcaggagaattctgtgtttatctgtatgactgtttcataaatgtttgtcttcctcccaatagtctgtcagcactttgggagccagttgtgttttgctcttgattctacctccagcacaggatgtctcttagtatttatggaaggggacatgaaaaaagaaaaagtccactgcatgaagatttaatccagtgagactgaggcctgaacatctagctttagggaagccagctgctagcaggacagactggtaggcactaggtgaggagaatggaaaaacacagggaaagagcatcattttctttattattttgcctctgacagacccctccaagtaacagattccaaagagattgtgaacattctccctctggtatggagtctcctgtcctgtcagaaatatggtacccagaggccaaagctgctgcataagcaagttgtcatgaaactattccaggacaggtttcagaagtagggtcttaaaaatgagtattaaatctaatgttcacccagatacatttccaacccacatatagacaccgaatttagcaatgaaaatggatgctactctgttaaggatttatttgaaatgttggttttctctcgtccatctgatacagatcatagctctgtttctgtcattagattgattttcatgtttctcaacacagactctcagagataagtttaatttttcagcatggccataggaatgatgaagtcattcctcattaagatgaagttaagcaaaatttaataatacttgtttaggattccttatttacttttctacacaaaaagagttgcaaggggaaaacaaaaactttaggtttgagtaacttccttaattcaaatatagatttaaaccactttgtcataatatgcaaatgaactattgcttttttccccacaggtctgttttcaaatagataatgagattatataaataattaccttatataaacttaaggttactcattattgaaagcaatcttctttttttgtttctggtttattatggtttaagagtgagtctttgttttagatacttgaaaacaaagtgtgtgtgtgcgtgtgcatgtgtatgtgtgtggatatatacatctagggaggtcgtcaaattcaaaaattataatacaatgttgtaatgtcagcacttcctattgcatagttttataatggggatatatagctatgcattaaaatgcattactgaaatggaaaatcaggatgtgttaaaaatgaattagtaattatattaagatctgaatgggaactagcatacaatctaacttaagtttttgaaaaataaaaaaatccagaaaataattaatgataagttagtttcagtattacactgataaatatttcaagaataagctataaaaaatgaggtagatttattattttaaggttcatactaaaagattataatatttatttaactttatttaatttagaataagattactgtcatctctctaagcatttatgtaataatgtattatttacttttccattaaatattactgagataaataaggagtcgtggtgaatgaaatataatttaataagcagggttttcttaggtgaaaactagtcatgtcctgctataaatgtatattgagagagaagctgaatagaccagctccatgatttagtcaatgacatgacttcagggaaaatgtttttatgccttattggccatatcttttaatacttgcattgaaaataaaattacatcccaagattatgagggttgtgaaattttataattagatatttaagtcctaaattgattagcagcagtataaacatagaaatggattttgggttaaatctgagaactattttcttatgctaaaatttgcatgcagatgacaataggaaaatcaaatgttttcctggaaaattttcaaatgggacaaatagtcgtctttctggaaatatgaaataaagggagtggtagtggttggactataaacctttttgaaggccttttaatctttagctgtaattcatgttttatcatcattgaattttaaaaacagaaaataccttagaaataatttagtgttaccctgttgatactaccaaaaaaaaaaaaaaaaaaaaaaaaacagtgctcagagtcacataacttgattcagtcagagctggtgctagatgcttagtcttctgacttctaattcagtttgctttcattatctactacctgctgctgactcagagctcctcagctatctgcaagtggatgtgtttattgagcatttacgatgtacatgtactactctcaatgcgaaggatgtaatggtgaatgggagcttactttctgactcaaatattagttttctctctttgtgttccaaatgaaagtgtccttttgctttatctgaagcaggaagttgtaagtttgcttattttacttttgaaattttagagaattggcagtggggtcatgccatcagaaacacatacatgcaatgcatggatgcactgtgtgaatgagctctctggaaggtggtagattatgggaaagaaggaagctcagaaagagagtgaaccaagtcaagaggaaagagagaagaaacaggcaagtgtggagcagaggaaaagtaggagggtcatgaatccattctgcaggtgtgtgctgagagactggaagaaggaaaagaaccaaggaagtctctgccatgttatcttagttttgttaagggtataaagagattgaagagggtttaactaggccatccttaaccctaggtaatccctagagtccttagcagaactaataatctaaattacgaatgtctgtgtgtgcacacacacagaatgcacttgctaatgtctatcattatgagtatcttctgtcttctccactacaaggaaaggaagggaatgtgaccctctttcctgattagaagtaactagggcatagtaacacaaatggatgaattaaactgtttgaaatggtgcactggaatatatttattttggggtaaatcatgaagaaatgaaaaaggaagagattctcttttgagaaaaagtttgtttcctattgtcaattgagcaactctgtgaacattctaaagataaagaatgattattctgtaaagtgctgggatttctggtgctgtgtgacaaagttcggttccttttgtctaagttagttataataatctttaatgaaaagcagaggggtcccctggtttggaacaagtacctgagtcaagagttgacaagtggaatagctgggcccagaggattctgtcgagttgacaaagccagaacagtacatttggacagaaagtttgattttcttatactgaatgtgatgatcttgaagaacagattttttttttttttgcatgaaaataaatctttattttcagttattacccaccagtaagagaaagttaggttaagggtataaagggattgaagaggtttctacttttgcccggtccttagtttgaatagccttccactcatccaaaatcatctcttttggaccctcctctttcacctcttcaacttcattctctttattttcagtgtctgccactggatgatgttcttcacattcaagtgtttcctcagtcacatttgattgatccaagtcactgcaattacaagatatttgtttctgaatgtatttgggggactctgttaattcatctttgacaattccccaattgtgagatccgctacctccatgttacaggtccttgtgcttcaggccactgtaatgtgaaaaacaagatctatcacttccactatacctatcaaattcatgtttgccgtgagaatcaaatccatctccttgacccattgcacgtccactgccctctcaacctcttccaagaccaccacgacctcaaataggtcagtcaataattggtctatcaactgaaaattcacctccttcaaccttttcttcaagtggcttttcaaatctttgttcacaaggtggtctcctttctggtcttctatcaattattttcccttcaccctgaagttgttgatcaggtcttcttccaacttgtcttattccttcttctttttttcttttttttttctttttcctctaggcaagctttattcttcgattcctctatccaggaagggggctgttggttgcattttacccaaatggaatgtgatgggaattgggagcttgagttgtttggagaaggagttgtcaatcctagcaaatgtctatagctggtgtgtggtgtccatcaattcttgagggcttggccatgcagactagggaatggtcagaacagagtcattcagaggtctccagagctttacaatatcaaggttcagggggtatagacagtaaggaaaaaggccatttcctatttctgtccatttttggtacagtagacagttaaggttttttcttttgactagcttttaaaaaattacttaggaaatggaaagcttataaacattcataagtgaattgttgaattgtaaccccaagtggtttccttacctagtcaccacttaaccagaaatattagaatacacggttcaacctgaattcaaccagggggataacctgcctgttgctcaagcagtcatcagagtttttaaaaacaaaattaagcaaaaaagacctttccccaaatacaatcattactacttagctttgtatgatccattcctaagaaagtcacattccatttcagaaaacatgactgcttaaggttcagttaaagtccttgccttcaggtgcttacttttagttttctttaaattaacttctgaaatgtttatcttatgttttgtgctgcattcctgaaaactgtaacctttaaggacgtaggcctcatctttataaaggaggaagaaaacaacaaggaggtgtctcatttgggaggcggaaggttatgaccaatgctggaagtcttcctcttccttacttgttattcaacaagatgggttctgtggtgtcgcatgaggtatgagttggaaatgaaagctacaccacacttcttacattcatagggcttctccccagtgtgggtgttctggtgcacggtgaggctcaacttctgtctgaaggccttcccacactcattacacgtgtaaggtttttctccattatggattctctgttgaataagtaggtatgagctacatgtgaaggccttcccacattcattacacacaaaaggaagatctccactgtgaattctctggtggacaaaaaggcaagagagctgactgaaggttttcccacattcgctgcagtcataagatttctgtgcagtgtgaattctctggtgcataataaggtgtgaaaaataactaaaggttttcccatactcttttcactcatatggcttctcaccagtatggcttcactgatgtacaataagatttgcactctcggtaaatgctttgccacaatcgttacaggcagagggcttctccccagtgtggatcctctggtggacaatatggtttgagctcccagtaaatattttccaacactcattacatttacagcattttctgtaatgtggactttctggtgccaagcaagttgtgagctataactaaaggtttatagttaaacctttcactgcacttaagggttttttctaaggagtggattttttgatgtatggtcagatttgaactctgagtgaaggctttcccacattttgagcaaatataaggtttctgtccagtgtggattctctgatgcacatcgaggtttgcactgtgaatgaaggccttcccacactcatgacattcaaaaggtttctccccagtgtggattctctgatgcacaatgaggtttgcactctgactaaatcctttcccacatgcactacaatgtaaaagactttcacccaggctgggtttttggatttttaacagtgtcagaattaagggtgtattttcccccagatttcttacatttctgatcttcctcttctttgaaactttcaggtaagtgacagtcattcactatcacttatctgaaatctttcatttcactccttattctctgcctctttaacatgttttctttttcacaagcttgtcttaactcaggtccttaagaatcagctttctggattttccgaatatgatgaggggattttcagcttcctcacatatttcagtttttggaaccagtaactgaaggttcttggtttcagcaccctttcttcctcttctgattcaccagtctgacgaccctcccctgggatctagacttccatgttttcagagtgcacttgttggctgggtacctgacctgggaagttttcttcttcctcctcctcctttttcaccttcaatgggccccgtagggctagggccatggcttctctcaattctgcagtcatctctgcttagcaggggaacgcctatagctgggagctgcccagcagaggtcaaaccccatctaagctttatgtttcaaaagcttcttcttgagtttcttcccagggccaagatgagtactgcctatgtgggcagctgagaggcgcgacctgagttcactggctctgcagcaggaggctgagggaccgggacctcagcgcctactggcacgagaacgatgacccatattccttctttcttaagcgccagaggcggctgcatctcctctttcttgtcaaccgcgccacgctggggtggcaacggattcttgcggtctttctggggctccttgcgcagctagctatttgcctgcccccttggagttggtctgggccgcagcctgagctgccgttcttggccccagggcccccaatgccgcccctgccagcttgctttttcttgttctccgctgccttcagcacctcgaaggggtccgattcgttgtcaaataactggtccaatcggttgatgaccgcgcaactgaagccttcctgtaagtgcccaggcatgatgattgctcggcggcacattcctccacggattgcagcgggctgcgcggagccaagagcgcctgcttcagctcatcccacaagatcaaagagcaaatttttaaaaatttgccagtaaatgtcaggcaaggtaaatttcaaaatgaatttttaacgtctctaaaatggagttatgtttgattatgagtttatgacgaattaaaagatagttctagatattattctagaaagcttcttgttctgggaaagagagagagtttggaaacttgagataagacctttattgtctattttattatttactgctaacaaactgcattttctcactgttcattggaataggtgggttcagggaacttaagaaagcctaatgggaagtgggaaaagtaaattatttcgtatatttttatgtgtacaaacagttgataaaggaggaagtgtagtggtggggtggatcatgcatattgggatagaagagatagtataattattaacaattatactggacattttggattaagtcctccaaattttcttatttgtgagggtacaagtcactatttacactatggtaagctgcatgcaaatatctgagtacctttctgttcctaccttcagctgggccagcactaagctgaaatagcctatacttagatgtttttctgaggaagtacgtttttccttttccctcagattcctggtgcctggtatagcacttttttgatttgctcttgttctggcaataggtcaactggctctcatggtccttaacatttcaggtaaataattccaacagttgtgactggaaggaatccaaatcaactcaaggcatccactctatgttcaaaatgccatgttttgagtgatttgtcctttggttagtaactttcaaaaatatgaggactggaaggaaaagatactatttgaggaactaatggaaaagcaagcagtttttgatacactaagatattcccttatgatacaaggagtgtgatcattgactttcctacttacctaaacattatgctgtcagagcatgtggataggcctagtggttaacacacatagaaaattcagactgcctagttcaattcccagcttcatcatttgctagctatataatctttagtaaattagttaactttcctgtgcctcagtctggttttcctgaagattaaatgaatttatatttcttaagtgcctagaactgtagctgatctgtaacaagtactgtatgtttttgtttaaataataaataaaatgaccggattgttcagatggaaaaacaggggtcttaggcggcttaggattttctgtaaagtaacagaatcatttgatggcagaaacaacgatattatcactgtccagaaccctaatggagaactatagctcttaagggtgatgtggggagaaatacactgatgaaagacaatcaacattattagacaagatgggagagagtgggaactagtcattcatttatctaatggcttagtcagcaagtaactatttaatgcctactttgggccttgacactataccaacattgtgcaggaagtgattaaaattcataagaacattcacttaggctgggataaacaagaggtcttttgcaaaatctgatgatgagctttttgatgttgagttgacaaactctgcagcaggtcagtggtggggggaaattatcataaaattccatcccttaaacatctacaggaagatgattattttaagatgctttacttctggagatgtatgctttacttcctcttagagaatctggcttatgttctcatgttctggttttatatgtaattggtcatgagcttaatttgatccaagcatttggcacagttacccccagaagttaactcatttgtggactgtataaacgctattgcacaaaaaagaagtatatatatacaaatagtcataatagaccacatctcggttaatagctttaagtctagatgaaatgttttaagaaggatattgacaaattagagaacattagaagcatttgccagaatagtgacatggcaagaaattatgccaaatagtagaaagagaattagacgcctaagtggaacatggtatataacccataagaatttgagggattgtcattggtagaataagatgttattcttggctgcttccagctgaggagtggtggatgggtgactaaggcctataagagagcaaatataaggaagagtttctaaatgctaaagtcaatttccaaagaaacagcctggcctctaagggaaagagcttcttgtcagtagatgtgtttaggtggggccagctgaacaagctcctgagctctggggattagactccatctgctggataggaggtacaactaagtcgtctcagaggttccctgtgttccaagattctgttactctgtgatttcatgactttgatgtcacctcccttaggttggttacgctaaataatgttaaaagtcagtgtatgccttaagattgggtgaattgctatgacgcaatgatttttaccagataagcggctgagtctaagaatgaaactactgtttctaagtgaaagaggtatgaaaacctaaagataatatttttctctgtagatagaaagaatttgtattataggtctgtgttggaagtatagcagggcatcaccagaattcaccctaactgggtgaattcacggcagtaatcagtggaatgtgtagtttgacaatgaggccttatcatttctaagtagtttctttttttttctttctttctttttgagacagagtctcacactgttgcccagagctttgccctggaactcttggagtccaatggcgtgatctcgtgtccctgcagcctctgtctcccaggttcaaatgaaactcttgactcagattcccgatttctaagtggagagttatgaatggcccaaagataatatttttctctatagatagaaataatttgtatctacgtctgtgttggatatatagcagggcattaccagaattcaacctaactcggtgaattcatggcagtgaacactgcaatatgtggtttaataatgaggccttattcttaaggcaaagctcagaaaagctgataagcaaattagaaaggtctattgaaaagtgtctgtctggccgggtgtggtggctcatgcctgtaatcctagcactttgggagcccaagttgggtggatcacttgaggtctggagttcaaaaccagcttggccaacatggcaaaaccccatctctactaaaaatacaaaaaattaacagggcgtggtggtgcacacctgtaatcccagctacttgggaggctgaggcaggagaatcgcttgaacccgggaagcagaggttgtagtgagccaagatcgtgccgcagcactccagcctgggcgacagaacaagactcagtctcccaaaaaaacaaacaggcaacagaacaagactgagtctctcaaacaaacaaaacaaaacaaaaaaacaaaaaaaagaagagtgtctgtctgccaacctgcttccacgaaggcccttcttctgattgtagaagtgcctggtttaggatggcagtgtgctctacctgctgtctggtgagtagtcaggattggacttctgtaagacactctgtatgagaggcttgccaataccttcagaatcaggcagaggtctttggcgagttatttctgaatgaagcatatctgcgtgtctgtctgatctaagcctgggaaccacgagggaagatactgtttaagcaacaacagcaaaaaaaaggcagggaacttaagagagacatggattttagtcactaagaacatgaagaggaacattttgataatatgtactctattttataaaacctgtagctataggaacatatatttgcctacaatatattttttttcttttttcacccttgatttttaactattttctacaacagtttttctttttttttttttttttgcccttgatattttttcttttcttttctttttttttttttttttgagacagagtcttgctctgtcacccaggctggagtgcagtggtgcgatctcagctcattgcaactccctcctcctgggtttaagtgattctcctgcctcagcctcctgagtagtagcttggattataggcacccgccaccacacctggctaatttttgtatttgtagtagagacggggtttcaccatgttggccaggctggtctggaactcctgacctcaagtgatctgcccacctcagcctcccaaagttctgagattacaggcatgagccactgtgcctggcctgcctttgatttttaactattcctcatgtgaaaatttaagtctttctatgggttaaagggaaccggtaaagagcattggatttatgcttgagctggaatttccctctaggtttggatatagtgaaggcagtggagatttgggtttataacagacgcagatttgtgaagctataaaatctgaagcctcaaggcccctcacttgcagagactccttccagggtcctggaagggaccctactaatgtgttattatggtcattattttataaaaattgtaaaacgtaatgtgtttcagccatgatttgttaaaattattgtcttcttccaattcaactttccctcctttgtccttccctttccagttgggtggcattaaagtggccatgcacgttttgtatttgtaattgtgcatttttttgtcttaaaaaggacccccaaccaaattgtataagtttcaggccctgaaaacatgggtcttccactgggtataggaatgaaataagtaacaatctggaaattgcctgtgtagcagaatcagccaaaagtcagagtcagcaatcaaaatgttgtgacgtggtgagtgagagtaaattcgaatccgtaatcccaacagcatttgacagtgggaaaatggggcttttttctcccctctttagggttcattttaaagaagaattccatgcaaagggtgtcatgaattgagaaatatacatcagattatatatataatatatattttttgtttgtttgtttgttttgagacggaatctcgctctgtcacctaggctggagtacagtggtgcgatctcggctcactgcaagctctgcctcctgggttcacgccattctcctgcctcagcctccctagtagctgggactacaggcgcccgccacctagcccggctagttttttgtattttttagtagagacggggtttcacagtgttagccaggatgatctggatctcctgacctcgtgatccgcccacctcagcctcccaaagtgctgggattacaggtgtgacacaccatgcctggcttttttttttttttttttttttttgagatggagtccctctcagtcgcccaggctggagtgcagtggcgcgatctcagcttactgcgatctcaactcactgcaacctctgctccagggttcaagtgatttccctgcctcagcttcccaggtagctgggattacaggttggtgccaccatgcctggctaattttttatattttagtagagacagggtttcaccattttgaccaggatggtctccatctcctgaccttgtgatctgcctgtcttggccttccaaagtgctgggatggcaggtgtgagccactgcacctggcctaacttatttttaaaaatagcaaattctttaaaataatgcaaattggtgatgaattatgaaaatcatgatgagaaactcctaactgaagagagaaattgtttgaaaactgtattctccttttcctctactactttatgtaattataaagcctttctctaaagttcctttctgacagagaaatactggccaacagaaattcaacggaaatttgagatttttgacattcaggcaatttatatggtgtttcaggtgttactacctctaatagtctatcaataaaaccctgataggggatggtctctcttttttgccttctactccatctcttctcgcacacccttgtgattgttgctagcattcacacttactctctctttatttatttattttttgagacagggtctcactttgtcacccaggctgtagtgcagtggcgcgatctcagctcactgcagcctccacctctggagctcaagggattcgagtagctaggactacaggcgtgtatcaccacccctggctaatttttgtattttttgtagagctggggttttgacatgttgcccaggctggtctccaacacctgggatcaagcagtctgcccaccttggcctcccaaagtgctgaaattacaggtatgagcctccattgctgggcacttactctctttttaattatcagcttgcaaatgagaaatctgcccaaggagcctgagcttggtgcatacaagttcatttcagccccatcggtgagtttatgattctatgagacattaaagatatattttatttggacatgttaaaaaaaaaactgtatgtttcttcacaacatccaaagtaattattttattggtgttgataattattattgaggaatagggtaatcatgcgtgttatcaaccatttcctaaatggtacctagttaacatgttaggggagggaatctaatctgaaagtgatgcccatttagtgaagccaagtgatgtagcaagagttgagaacaacttataaagggacctcttagcccatgtccagaacattgtcattaacataaagataggctgccaagggaaaggacaactgtatggtcagtttacccagatctgaactctcaaaaatcaagcactctcattctgttagggtgatgtcagagaaaataaccttcacaaggtttgaaaacacagttgtaacatactgggctatgttccagggctagcattggctcagatttttatcttgtgcttagaaccagcctactgttgtctctgcagagagaacactaagtaggtacttaataatactttgctggccagcacatagctctgtgcagaacgaacactaagtaggtacttaataatgcttgcaggccagcacatggatggatcatgtttataagtgtgtatcgtaaacactttgccttcaggaaattgtttcctttttagagttttcatactgtggacatccttaaaaatcccagaaaatgtatctttatggattgacatgtgactcctacatgttaagttagaatccaatgaaatgctgttctttgggctaaactttcaagactcatgtgtgtggtgtataattcattaactaaagatatgattcatactttaccttatgtaggaccacaggtatccacatatccaccattaggatattcttcaaatctcatagtttggaagattttcagacattgtaaacagtaaatgcatcagaaataagcattttccagaagagggaggtatgaaatagtgattgatcagcctgttgcttagtcctggaaatgtgaaatcagatcaatacgaaaaagatgctttccttgcattctcttccagaaatatgcagcctgctgctcttttgtcttcagtgtaatcatgctgcagtgaggagagcccagaactgtttttaaattcaaaaggacaattgctttctgctcactcaggtccactgaggcatgctccaagacaggaaaaaggtgcttagcaggatctctttgctagagattcaatatgtgaattttactttgagaataaaaagttcacccacttttaaaaggttaatcaaaagcacattgtagtgtattcttcctttcctatgcaatttcctatggaatctatttaaattctggctgcagagcagcaatatttttcaaagaggcagtccttctgccaagtggctctagaagtacccataatctccatgtcagaagtatggaaaatgaaagagatgaacacttccttcagaaattgtacctttgattcctttactttacagccaggcaggaagaatcctgagagaggcctttaccgaaagttcaatatttatgagctacatactgacaaatgaaaaatgattcctagccctgagttgcttaccctatcaagtttgcccattattttcaggctgttgagcattgtttgaaaaatcgatctgggagctacctgagtctatccattaccatggtcttgctgttataaattcacactgggttatttctattccctaagtttgctctgccctttcctaccctttacctttatggtcttccatctggtaaattttctctcacccttcctggtctagctgtccttcgtcttcacttatgaaggcttccttgttttcctttttcagaattaattgctaatttctcactgctctctaagcattaatacacccatcatagccttcatcataatatgctttgtactgtagttatttatgtacttatttgtttttccccttctttgttcttcagttaaatgcatgccagatccaactttacagatgggaaaaatgagctctgaagtttaataacttgcccaaggctacccagttagaagagttatggacttcactctgaatatggtgacttttgttctcgtgtgttgccttctttagtcttcttaagaaaaaccttgtcttgttttcttttctccttaggttgacttattctatacattagaagtttctaaattataatcaaactggcattccaaggtcatagccatatgtaaatcagaatgcagttttacatagattcattattactgtgcgtggagattagaagccagctcacaagaagacttaatttggaaagataaggtaaccaactttacatgagtgctagcctttcattgatttctcacctccattctatattcctcctggcacttgttttaaatctgttctactgaagtccatactctacccccttgctctcagccgatgatctgtttacctgctctgagaagatttagatcagtagttctcaaactttaatatgtataaaaatcacatgcagagctctttctaacatagtttcctgggccttttcccaggaattctgattcagtaggtcagggtggggctcatgagtgctccgttctaacaagctcccaggtgatggcaacacagctggtctgaggactacactttgagaacctctgatttaggccatcctctgagataggatgtcttcttccatacgtcttctctggatgtttatccttcctctccttctgtgagtgagaattcagtcattctattctcaggctgaaccctctcaccacaagcttttatcccatctcacttcatctatttcaggaccttgcttccacttgtctctctttgcatcttttatgtcaccctctcaattgccttttattctcccctgctttactaataaaactgttcctttctcagttgtactgttttagatacatctaatgattgtaagcaaaattattttctataagaatgcttgacaatttcagattcaactcagttggctaggaactaagtttctgtaatttgggaattgacttgtagagagcaaaattaagaaaccaagtttaactttttttaatggatgtgagtggaagagactaatgagatactacaaaagagttaacttcttacatttctgtagtctaatacgagatagtttctccaggaattaacatagcacatctggttcactgacctgagtttgtttcctggtgaggctttgcagtatcatccatatctcaggcaaaggtattccagcattttgtagttaagcagttggaggaggagtagggagaacttgtgtactttgaaacatttcacaatgaactactttgcattctaatgatgttctccttacttaaggactttgctatgtaaagatgctttgtccttctgataatcacttacacttttcttctgtgttcatatcacttcattaatcctggttacttgtaatgaatcataatcttacccacttattcttgtgtgactcattcctacttgtattctttttttttttttaatttatttattattattatactttaagttgtagggtacatgtgcataacgtgcaggtttgttacatatgtatacttgtgccatgttggtaatagttgtctgtgtctgataacacattgtcaattgactatgctatttttaatgtaagccttggcaaaaaggtttacttagagaaaagctgtacatttaattcccccatgcctcagttcccaaatttactaataaagattatacttagctgtcactccacatttcatcagtagaattaaaatgaatagagattatgaaataagacaacaaaaaagatataattataatggaccagaatgagaaatcactacagatcaatgcaaatgacctgccatgtcagattcctagatgcagtttctttagtcagtgggccatatttcttcctcattctttgtttttccatcatgccttccaaaactaaattttaaccaagaaggaaatatcatttgtcttctgatataggaagatcctactgagagattatattcgtatatttcatccatcggcctataggtggaattgtatttaaaatactaataaaggttattattgcttatatctctaaaaatgctccaactctccaaataaggcttatattgttgatgatatttatcagtggctctgaacacttgcatatcataaaactctccctcaaaatttaaccttaaactctttcaggcttgtcttcatcacagtgggaactgaggacagctgctcatgttttttgatagaacagctcttaacatgcttttgctcttgcctcccactgcccaacaccagctgcgtacacacactccacttgctgtgtgcatgctctggctcctggctccttttccttcagctaagttagcctggttttatttggtttcatcatacgaagtatctattagtaaaacttttatgaactctgattatagtactaaactcacaataaagtaatcagaacttcatttattaaaacactgggctgagcttattttttaatttagtatgcatgacaattttgtaaggtaggaattttcattccccttttatagatgggaaaactgaggtccagggtgtaggtaacattttcaaagttaactcagaagtaaatggcttagctgtaatttgaacccaggttcctacaattctaaagcccacccttttaactgctgtgcacacaattactgtgttcttacttgctctctgaaatacaacaccttattctcatttcatctgctctttctgccctatacacttcggtttctgctctgtagatacctgctgtggattgtgacatctcaattttttttgtaccttggcagggttttgattgatgtattggtgttccgaactctttagcatatatattaatatggaagacctaccaaatatttcatctaatagggattattttgtctacctatttcatctttctttataatgtaagtttgtagaaggaagaaactataaattgctcaattagggactccacagtgagccaagcgcatacatacttgacccagagaagtcatcgccatctttatcaccacagctaacatatgggtagtgctcaccatctaccaaatatgtgcatggattattttatttactctttacagtaaccccataaagtagattatgttgccatcccaaggttaaaaaactagtccacgttcatcgagttactgcatgatagagttcgagcctaaccaacaccaatctatccacgcatctgtccacacagttaactactccacacttctcagtggaatctacagttccatgtatttcgtattccttccatttttcactatctgtcctcttcgccatcttagcctgtttctctccttttcactttctgccctatgcatacctgctcaatcttcagtcttctctgccttaccttctctttctcaattttgttctcgttctgtcctatcctgcctccccactcttcttatctcattttcctagtccccttgtcacctttttacctcttacatatttctttttaaaaagtaacttcaagcttgataatagattcttcaactctcttagcaatatcttatcctaaccataataaaatgataaagtgctaggtgtaaacagaagtagaatatgaaattgaagtgaagaatctctttactttttctgttagaaacgtaaataatgagtgactataacatcttggtctccataacttctaagtgttaaataaaacacatttctctttttttatttaacacacacacatccacacacacataaacttgttttatgcattgattgccatttattgagcagcataattttggaaatgcaatagctacaaaacaatttttaagttattatcatacagtgacattaataggctcatcactttgctttctttcctttgttctatcatgtagagagttgctttagagatcattgtgtattgatatgaattatcgttgaagttttattagtctggatgtctggttttgggcattttgataaatttcttttgctccaaatccagaagttatggccattcagctttataaataagacttttttaaaaaggcaaagtcataaaataaatatttcaaagcagtgttagatatagccagctgaataaactgccctttctatttaactttgaactctaaacctcatttaaatatcctcccttttttctctaaagaaggcaagaaaaaaaaaaaacaattacagtagattctaaaataaaatatagcaagaacatttttgtaagagatacctcagatagaaggctgtaataattgggcaagtatttgcacctaaccagtagaacttagaagagaaaacgtgaaatgaacttcttagcttatggaatggtgtggataggtttgcattacttagatgtttacagagctctagcatttacttactgaaacactggaatggttcatatccctgtggtttctacctcatttcttccagaaggattaggttgtatgctgccagagaccacactgactcttagtaatgggatcaccaaattctggttcacaattttgtgcatagagagattgcactaatatctcaaaattgtagctctgattataaccctggtatagaaatctgagctatgttggcagtgccatgctgtacagtcgaatccacctgattatatctgcatttgtgacagctgggctggccttcattggcatatgcctctttgctgtgcccagggctttgaatgcaaaatgaaagatcagcatgatattaggggcccatgatccatagaggtagcttcccaagtaaacagtgtctcagctttaacatggcccccaatatcctgctttatttttctggactgaagttcctatgacagatttgttgctttcaaaaagtaattttgcagatttgtccttttttaaaagaaataaaatttgcctccacttcctactgaaagtgatatggtagtatccatcttataattgcacagattcaaaaataagccacaaatatgttagctgaagtataactgtggactataaaatacagatatcatagcctataatatggagggtagtttgacgttataaagccatttttctgtgttttacattatcataaaatttaactactgaagggaaagtgaaggttttaatatttaagtaagcctagcacttaaagagaaacacacatattttccttggaaaaaaggaagttccattttggacactgcaaatgacggtgccagctgttgtcatagtatttctagcatccactgaggattaattccaggcccagcaaattcactggatgagcagaaacagccaaagaagtaaacactggtgcttctgccgtggtattattaaattacgcgggagacttctgcaaagttggatatctagtgaacgctggattatcatgcctgagcatcattcactttgtggatatctgcagaaaactgaatcccgaacttgctttcttctgcctcttggccctcttcctctgtagaggtatactcagaaaatgtgatctcatttgaatataaacttttctattaatattcattaagtactcatacaatataagctgaggaaacagtggtgggtataaaacaccagcctgatgtaaagagcttactttcactgtagaggcaagatagcataatgaaacagagatgggtttcagaggcaggtggaccagaattcaaatcctatttcttctaagtatggccttgggcccatcacttaaatttctgagactcagtttccttttctataaaaggtagatactaaccatgctacagagttctgttgagaattagaaatatttacagatacttagaccactacaagatagctctttttctagaagaggcataccttattatatataatctatgaaacagaatatggaagatgctaaatgaaaggtacaatcagagaatgccccaggccctcaagaaggaaggtggaatggatgaggaagtctgctgtccaagggatgggccggagctaaggcaagatatgtgtgtgggccttcactaactaggcacagggagagggcattccagcagcaggtgtaggtccggccaaggaattaagacaggaacgcaagtggcgttttccaggcagaagattaggaagttttagatcagcctggatacagagaccttgaatagcaagccgactgaggaatgcatggaagaatgactactagctggagtaaaacataaacctcaaggcctcttttctctttcacctttcctcttgcccacatcacggacagacagttcttgcttttccttatactctgtttctgtgagcaattttaagaaggcagagtgcataatggtattacttttatgtctgcatgtgtattgccacatgaagcctgtagttttgcttttcaaactactagattgtgaccttgtaatgatctggcaaaaggctgattgaatttataagagcagtaaattaatatagtggataatagtgggaaaaaattagtggctaatactggggaatgagaagattaggaaagacataaataaaatatgggtggtgtaaataaaacttaaagtgaaaatatggggaagggactgcttatgattcaccttacagccatgtagaaattttgattaacagagcagtgtatctgaggcatgttgtaaagaatggactggggtctgttttcactgtcgattctttctgcgagtgcatgttcatgaagatattggaggctatttttctataggcaactggtggttttctgctgtaggcagaagtagttgaggtaatcctagggaggtgacactgaatggggctgtggtcctactttatgtaaggttattatacgtgaaagaaagagtaatttttaaaagtaattaactagtggtagattatgaactaacactagcaaaggttgattataaatcagattttctttttactactgatttggaaacaatctttggagaaatagatttggaatggttaaatatcacttttgggagcacattttgctaccacagcttaacggtactcttaagagaaagctttacaaatggggcaaccttgaaagacacatttcatatgcattcaaattcaagatatgaccgaaagctctgttgccagggtaaaggttttgagagttaaatgggaatttggaaaacaatactcaaaaattgacttaaaatgcagatgcagataagcctacaagtatttaaagtgtggagacatcaaagaatgtaagaaatagtttggatcactaacaggaatgtgtaatgggaagtcaaaatctatgctgtcaggaaaaattcatattattgggtagaaactctattatttggtacatttaagataaaatgaaaattgtgttttcaaagggttaggcctcatagtggatgagtgattggggcgttttctggtttcagtgattctgtaggcagaaaacagtttttactgccaagtgtgtcagtgaagcgggggagatagagaccttactgtgttaagtgaaatctgttgcttaagaataaagctggcatttctgtagaatggagaaggaatttggtattatcatatcatcaaaaaaaaaaaaaaactgctctttgaagagtagattttttaaagtctgattatcagtatttatttaaaactactgcctaagtatttaaacagtttcaggctctgattttatttttgttaaaaaatgaaacctatgcctaaaaattattttaagtagttatatggatagatgagctacacagtttcagacctgtgtatatgactttttaagaggtctgtggtatccaataataaatgatcttatgcagggatttgacacataatgggtcatgcattatctataccttgttaatgggatctgtatagagtgatagcagaaaagaaagttaattttaggatcctttaatgcctataaatttagagcaaaagaagtatttctaaaagctcatcttttgtatacatatgcccaatcacaagttttaccgacatttttacacgttttaggcctgaagtatttgattcagctcttatttgtcaagatacaatatgattacattagtaaaatacaaaagggcggataagtttttcttcttttgcctatcttatagtcacgctgcaaagcctccatcacacttttttggctgaggtagatctagatgtatagaggccaactaatatagttttatataatcaacatagggaagtcatttcagagactggcattgagctcttggagggaagaaaatgaatcttaaagcttcttgggaatatccctcactgcagcagaggttatgtgctctaatggatgctccgtaaatgcttgagagaatataagtcccataggttagcatgtacttaattctacctaacatggaaacctctccatacattctatagctgaattattttaggagctcaaaaggagtaacaggaactaaagggaacaccagctccaagattggatttttaggctttcttgctagtgtaacacttcctttcctattggactattggcaaccatatcctggctaattggaagtgattttcaggggaaaggaagaggtcataagttcttgcctccctattttccttcttgttgggttttagtaacttaccttaagacgtagtgtcatcctattcaaactcctaatattcagaaaccgactttcattattcaaacatgttgaggaaaaaaatgtctccttgcatcctcctctgcttaaaacttctccagtaccatcaagcgtggacagatatatgacagtggcagtatccagaagacacaccatctatgtaacaaaccctagaaataaagtatggtataatcctaagcattcacttggcactgtcgcttctgggaatttgctatgagtcagccacaggcatctctgtgtaccttcaagcccagcttagcacatatgggaggataagagagaacatgtacttcttgaatacatcttctatagagtaaactaatccttagctaagttgatgatatcctcacccagaatttaaaagttcagtagagactcttcttgaaatgttgaatttttatttctgcttattgccctttatagctgggtgaaatgcagtgaagatattcactggtactataaaaatgcattggttctttttggtgagctacttgactatcagagccaaatacgtaggtagttggaattaaatttccaatttagcatcccccttagaagggtgatagaagctccaatgtcttggtgtttctgtttctgagtatctgctgtctcactgaggcaacatgctagcctccatgttgttttatttcacagacatagaactaagtgacacatctgccaattccccctcccattttctttgatggaggtagattacatttggtgtagatattgcttgaaggtacttgttgttctttcttacaagtaaacaagaaagagagcagcaaataatagctagaaggaagatatgcccacagcacattcaggccacttagtctatctagtaagtacttaagagtgtttcaggcatcaagcatgtactgggagacatgcacacagaaaaaggacaagcaatagattcctttgagagtgacatggtaggtctgaagagtgaatgtaactttttgtctccatcccctcagtgattcattaattatttattagctatttttttccaccaggattacaatcattttacatttgcttgccagcctagtgggttattaatagtggttactctatttatttacacattttctattgtacgttattcatcctttattagttcacccccacccctggtcaccattcttttttctttcgtttgacctttcatggctaccgtattatcaagtgatcaggaaaaaaatgcactggtgtcagaattaggccaacacagacatatgggatggtaggttcatttgggttgggtagagagctgtttgaaacttgtatacacatttttcaatttcaagagggaacatttacagtaaaggaagcatgatatccatagtctgcagtggtctaatggaggtgagctcaggaatctcagatgcatgtagctctacaagtctccattatacaaattatgttgaatatttcatctcttgcgacagattagttttgggccatcatgaaaaactttcctgaagattaagtcaaacttatctatgcatgccttctttggatacgtagatccacccttgacagctactctgtctactaattctgtcaagtaggactgagcttttctgaacacctctccttttgttaacaagaaggagaagaagaaaattaaacactcctggcatctgcctggctgtgatttagcccttggtaaagagtattacaaattgagatggtgccagactgctcctgtgattcatctcttctcctgtcaagaccagttgaagcgatgcaattggaaacctctctagtttgtgaagagacactttatgttggaaggaacagcataagcagaatagtacttaggccttcaaagcagagacaattgatttctctggattggtgaacaatcactgcaaattaaggtcaaacgtattatcaactaattcagtgtactaggcttcttcatcatttcccacgacttgttctcttttagaagatggtttagcaaattggagcaattattttttaaaaaaatcttgctgcagagttagtgataaaacacaagaaagtttaaggctggatatagcatgtccatctttatcaagacgcagatccatagagaggtgtgcttgctcttgggatactgggtgaaaatccaggcactgtgttgcgggaggctgatttctgaaagttggggcatcattgtttggcctgtgacgtttgtgtcaggtatgtcttgtcccacagaatactttttatagctgttaaaggacagattgtcttcaggacaattggtacccgtgccagagtatggtatattctgaaagaaaatccatttactctcatctgtaatttatccccttagttgaaacatgatcccagtgtaggacatttacttttcacattccatttaaatcagtgtagtttcttcctatcttaatgaattttacctcatttctttgtcttgcaaaaacccagggctgaatggtaaaatttcaaaacaaatctttcacaaggctggaactagacactctgttgggtcacatgcaagttatttgcagaagaggaacactttgcatgtgaataagagaaagcaaagcacttacaccaatactcagtgctcttggggccaggagtgaggggccttccatgtttgcaggacatctatttgggccttatattctgctacagccccaagtccttacctcatatctgcctggtgtcctatttttctgcttaaagagtcaaagactgaaattcttatcagtgtttcccattcattcctaagttactttggccttcacgtggagccaccatgctgtggcccacaaagtgtgctattcacttaaacttatttatcttaaactttttatgaattgtggttgcattctttgactttctttgctgatcacagtttacattaatcctgggacatttgactcttaagcgctacatgatagtactatctaatggtttccaatgttatacgaatgtctctctttcccatttcatccctttctctctgttggttttgacttgaagctctctggttgtttcatggcaatgattattagtgagagtattatctattaccaagtgtttcttgttcagttttgcatagtttcaatgtctttttaagcaaggattgccaaactacaagccacctgtttttggagatgccatttaattggaacactgccatacccattcatttacatatcatctatggctcctttctcactacaagggcattgtttggtagttaaaacacagaccttatgtaccttcacctcaaaacctagaatatttactatctgactctttacagaaaaagtttgctgatctctgctttgaagaagaggaagtcatcagatacagtgccaaagaattgctggctatgaaagagatattgcagaattctataattttcttaaagaatggaaaacactggaaaagagtcacctgtttacaggtgatttgcatttctataggtatcagaataatgtgtgtgcttgtaggttggggaaggaatggcaggcctctctctgtcagtatcttcaggccctgaagtcatacaatcaatggattgcttttcctcttcacttttccattttgccataattttcccaagggggaggttggaagtaggtgaatattttgagctaaaagagcatttggatacctcctgatagttactttagctcagatattcttagattctctctactgaaggccacaccttctctgtgcctcagcctggcatggtccagcgtgctacttaccttgggttcctgctgctcagcttaaagggaatctctttcatatgcctagagccttgtttactcagttcaggtctgtgccagttgacgccaagtcaaaaagcactttagacagaagcttgctttgaaagtgctagctagtagcaaataagtctggcttaattcccccttgagtctggagatctgattggaagagtaaaagggagaaagggatgatttatttgttgactggattgactactttatattagtaattatgaggcaattctacccacattatcgcatttaaatctccataaaaccctacaagggaggtaatatgctttggaaaactgagactcagagaaattaagtaaattgcaaagtccttatgctataagcattatagtctcataagcaaatgtcatgagtttcttctagctttttcctcatgctcacaaaatggttgaaggagatccatcatgtttctagttaaaaagaagatgcagagtaacaggcaaaaggtaaatggacaagccaatcaagtttattctctttcctagatgtcctacttgatgacttcagcttatatctcattagtctgcatcataggattatctctgcaagggaacctggaaaatgtagaaatttgtgttaagctgggcaccttgccacctccttaaaaatgtgctctataggtacagagcaggagataatcattattaataggcaacttaccgtctctgtttcaagaggtcgttctggtacctgagaagattgacaatctctggtctacactcttatagacctctcttgccttcatttaagatgaacttgatagaataaagattattgttcttctctcatctcctgggtatgagacagagaggtaacagatggaatgacttccttctggcttccatagcaaaccaaagcatgtgccagtgaagagtggcaactgctacaaatacttagccaaacgtggggaagagtgttgatgctctaagtctcctagctatgtctaggcagcaggtgtctctgtagatcacggcagcaatccctttggtaagggcatgaagagggcactcgggactactggattgcatcaacttggcagagaaaaatgtagcatgtactggagctctagctgggtagggaattgacaagttgaaccacaaattgactgctgttcagtcagcactagcttttatcttccagtcaccgttccatgtggctcttcgttgatcatccacaagctccaggcctgggtggtgcctgttgtgatataagaagggaacagtgatgtctccaaaatgtgaacactcatgtgtacagttttcatattggtaaggaaatgctagaaggggaacagctgtcagatgcctccctctgtctttgtacatacctggctacccatggcaaagttgttgttgtttccttccaggcatagagccgcaaatgtagaaaacaagcattccagcctgcaaaagaaaactgaatcccccttgtttggtcacttaaggaatcaagctcaggagggctggacgtgttttctgttgctctacaataggggttgaaacttagttcaattatggtgcttagctgaagcaccatgactgaacctttttttgcgaaggggaaaggagaagattttaaaatgaaatgccacaagtgtaacatagtacatatagaggtcacaaacttggaaagcctgtggtgtcttggaagatcacataaatgtgtgaaacacgccagttgcacacaggcaagcacatgtcccttctacagaaattattgccacagaggaatgctggttctaatctccatcctcccttcccctcccctctgctcctataaaaaccagaggtttggaattttgcgtgaataactcagtttgttagtgttgacaaccagggatgacagtagctcatttgaaccctttgtccaaatcaggaaaccgcagcccttccttcatggcagccctgtagctgtgccagttgagtgtgggctggatttcagcccttactctctcccttagctgagcctttgtgccagacacaagctgcccaactgtagacagtgggctcagaagttatcagtgttacatgagcaaaagaaaacatatctatggaccatactcagcccataggttattattttgcagcttctgcagctgtggtcaaaacaaagctctagggtcagatcacctgggtttcaatctgggttctgcccttcaggcaaatgactcagtatttctcggcctcagcctcctctatctgtaaaatgaagataaatacttgtacctacctaacagggttgttatgaggataaaatcaataatgtgggacaaacacttagctctacagagggtggcacatagcacttaatgttatataataccaaaatcatgtgaaaatctgattttttcagacttagagaattcacagcatatgaaatgaatgggagagtgcatgtcagacgtccatgattattttctgcttcttgaggaaatgcttatgcctcttttgtcactgtgaagacaagagaactcgaaatagtaagcattacttagcagctggcctactaaggccacaagaacaaatgaagtaaacactctacttgaaccactgattttgtttgcctgcataaaacacttgcacaggttgacagctaacatccataacaatgacatcctaaaaccattaagaaatgattaaattaagttcattatcatctgttgcaaaagacaaagatgtgtgaggtacgttttagaataacttacaatgaaaacaactaaaaagtgtggaagtttaaagtggcaagtattcagttacttgagttcatctgctgcactggtgtattctctggaagctgggccacagagttaatattccatctttaaagactgtaacagttgttttcatctaagatgcatcaggttctgcataaaaaatttggttgctggcactgagactgtgctaggaggagggtattaacttagtactgaccataatgaaatctgtggttgactgcaaggacttgggttgaaataagactaaatccagtagtattgctctgataggttcaatcatattcaagtgttcaataatgattataaagaaatgtcaacctgtcatacttactttaaaatatgtccagaaaagagaatctaagaaagtttatttagttccacctgcatgtaaattagcttttttttttatcatgacatcaatgtcattaggccctaaatgatattaagagtgtctatgagaccccaaagacaaagattgtccccaaaactcctattcttatttgtttaacatggacttggcccagctaccttcaatctaaagcttctttctctagagtaaggtatctcagtctttgcactgttgacattttgggccagataattctttgttcttggggctaccctgtgcactttaagatgtttagcagcgtctctggtctctacccaccagatgccagtgacctccttcccctcaactcatgacaaccaaaagtatctctagacattgctgtaatgccacctggggagagaatcttcctggtgagaaccactactctggactaagaaaagtagccagatttttaaacacagaagtgtttttcctcccgggggcaaaaagtgccctagagatggaagaattttgaaaataagctcttccacaaactatactgccaaaatggttagagaaagatcgtataatcaccatgcttgacaaatgatgtttttgctaagcctcacagcagctttgttcatgtattgtgttaattgcaattaaataaactagtctagaagtgtgggtcatcatccagcccattcgtatccctcctttacagtacacgtccagacttctttcagaattttgcttgcccattggtgctcacatataaaaactcagtgggtgagagttagggattcatagagcagagagggacctcagcttttcatatctacttttcttgttttaaaagacaaggcactgaggtccagaaagtggaatttgcagcacaaattgctatgataaacctcagtgattcagcccctcggatcttcaacaatataggcacagaacatataactattactgagtaaaatgtttaaaattatgttcttatggcaatgttcaagattttaggcataagtaagacaaagcagaggcaaaataaaaaatacttttcaaattgaaggcttaaaaaattaaggatatcctctatgcaccttctgctttaggatccagaaacttatgtttgtttgctctttataacacatgactgtgtaatatcagccaattgtgactggtaaatttccattaatttgcctaatcgtatttagaaattatgcctactaaataaattatggttggaacttgaaaggaaaaatggcttaaataagtgatttgttctttagtcagaaaaatattctcactttctctctcttgaaccctcatgaagcactgccagctccacctagtttataattaaggcaatgggaccaaagtcatcctgttagcacaggctggccatccctgtatccaaatttctttgactaattggagaaaaccactaattgtacattttaaactcaaaatgtctttaagtatatatatatttaaaatatattttatttttattaatgtattaattataattatattttaaattatatttataattatatttagatttattatttaattaaaattataattatatttattaaaataataattatttttattaattcatacatgtatataatttatgttttctccatgtggttagctgttgatctaaaggagaaagagcaaggcagaaaaattatcaggttcagtgtttaactgagagatgaggacatcactaaaagaaaggtacagcatgttctaccggtacatacaagttttgattacaaggtgtactcttgccgcctgttatggtatctcagctaactttagtttgtgattagtgggatctctgagacaactctccgtggtcaggtatagagctcattttgcccttggcatgttccaaatcacttcctatgctcaaccttctgagcaatacaagaaaaacttcctagtgtggcatgttatgaaggttattttatttaattttatttatttatttatttatttatttatttatttattttttgagacggagtctctcgctctgtcacccaggctagagtgcagtggtgcgatcttggctcactgcaagctcctcctgacaggttcacgccattctcctgcctcagcctcccgagtagctgggactacaggtgcccactaccacgccgagctaattttttgtatttttagtagagacggggtttcaccgtgttacctagcatgatctcaatctcctgacctcgtgatgtgcctgcctcagcctcccaaagtgctgggattacaggcgtgagctaccgtgcctggcggaaggttattgaaatacttcaggaaatgcctttgactttgttttggacttaagatgatgatttcattcagaaatgggtatagtgtcaaaatatggaatgtgctagtaaaataatcacgcaattcacttaaagaaacgaaaacaagacaaaacaaaataaaacttgtttgggatgggtgaaaggcatggggctgccgttcatcctgattttaaggtgagaagtggttgaaagaaatgtgatatttttacctaaaccatggtcgactatactttcactttttagcaatgatgtgaatgaggaatggctttgaagactgttggtggatttaacaaacatttatcaagagcctgctgtgagtgccaccattgtaggtggtagaaattccgcaataaacaaaacagagtcctttcttaaattttgtgaagggagaccacctgtaaacaaatatacgtcatgtcatgtagagataagtgccatggggaaaaacaaaatagggtaagaggctaggtggagcaggatcagaccaaggaatttatattttatataagattgtcagggaatgcctctctaattagatgccttttttgttttttttaatagaactgaaggaaataaaaggacgaggcttatggatatctgggggaagatgtcagaggctgttataaaagttacaacaggaaactgattaggactcttagccgacttatatatgcttagaatgaaagggattgggataaaagaaaagaggggagctttgggaaagcattaaactgtggccacagtactgattggataaaccataacactggagtgtctgcaagtttctaacatttttttaaagtatcagacccatagccctagtaataagcaacatggtcttttcttttagcatggttgtaatgaacatggtattcttttggagttatcctgcaaagcttacctactcgggaagtaatagtttatatgcattgcccaagttgaatattattaatttgggttgggaagtaatatgaccacattctgactgactataggccctagtccagttcacctgattttatgcccaatttttaatgagaagggagcttgctaggccaggcaggaagaaatggggacagtgtctaggaggaaatgcagaagagttgagtgtaggtaaatcccatctttcctggctttacatcgccttcacatccctcatatgatcttctaccccagtcttcagtataagcagtattttgttctgaagaaatgaagtcttggccgggcacggtggctcacacctgtaatcccagcactttgggaggccgaggcaggtagataatgaagtcaggagattgataccatcctggccaacatgatgaaaccccatctctactaaaaatacaaaaattagctgggagtggtggcttgcacctgtagtcccaactactcaggaggctgaggcaggagaatcgcttgaacccaggaggcggaggttgcagtgagccgagattgcgccactgcactccagtctgggaactgagcgagattctgtctcaaaataaaataaaataaaataaaatgaaataaaagtaaaggtatgaagtcttttccaagctaaggcaagaatgctgaaacctcaatcatagcacttttccaaaagagtcttaccttatattctgaatctcttccttatctcaagaggggcttctttctctttaaatgtgaaaagaagagaggcatcagctagccctattagcccagggctaagaattgctccagatttttgaatgcttaaaccttaaactaggtcacatgtaccagtggaaagtggctcccctgttttcaaggacagtcagattttaactacctgcctcttaggcttgccctgtctttggggttgttaaatatgcatgttgggagctgttgactgttttttttttttttttttttttttgtcttataatttacttttattttaaatctattatactttgaactgttgactgttaaagaaagcagtactggcttaggatcagcagagaatatgcttgaattctatttcttaaactgaggagaatttctgtttgagcccagtccaagtcattacttgagcaattttttgtacattttgcttgcttaagtgtttttttttctttttgcttttacaagtaatttttttaaggttatcatacactcagcaaacattttttgagcacgtacacaatgcccagccctgtgccatgcatgttcgaaaaaaaaaaaaggtaacattatatctgtgcttgtggaattaatacatttgttagaaggataagacttcaatcaataaagcaatccaagaaggaacaagtacaaagcctggtaggagacattagctcagtggaaagagtccactgaggtaggtagacttgggtttgagtcagagcttagactctaaacaagagtgtgcttttgtgagattttgcttatcctgtgtgggcctcagcttcctcttctgtaaaatgggataatagtacctattacattgtcacattgtattgctgtgatgacttgataatatttatatacaaagcaaccagtataatacatgctcatagtaagcacttattatattattattatttattggacaaataattagatctgggttataatcttgattctacaattatttagtttcggtaaatcacttaactttatcataccgttcatgcgtattacctatagagagaagggaacagaggttctacaatttatctcccaaattccatggtattttgaaacaaaatgtattaaataagtctttgatgtatgcttctccttcttgttagtgatattaacaataacaataaaaatcaatatttatttaggacttgctatggagccacgagtcgtggtgggttcttgacattatgttatttactccatgctgcatactcagtgagacagataaccttgtcttgtttcctagatcctaggccatattttatccagtttaatatttctgaaatcagaatgtattatatagttaataaatatatttaatgtggaaattttttcccaaaagccctttctaagtgagatggaccctcttttaattgaggatgtcttccaagggaaataaatattttttctatatttctgatggtacagttgaggcatagagaggataatttacgtcaccaagattaatgaagtaacaaaagcaaatttaggacttgaacttaggtttgttttatttaacaatactcaccctaccaacttcttgggagcaaaaaacttaaaagtttctgacatatattcattaattctttccattttttatagcaaaatatatttgatctatcactagaatgaatgatagattgactatttattaacttttaacaggaatatattttagtccctctagcctgactttataggctatgtactcagcacatgaaaatatatagtagcctcaatttaatgttgatgtttatttgatgttgacgtcactagtgacactggtcaagtgtatccttttagataagatcctattagaattatatattccctgtagaaattttaccttgaccatagtacatttaatagcagatttttctcagactttcaaaatcctgaaagtctgggtcattacaagaaaacaaggatgtggtcataaacagttgattattaagcaaattcattgaaaattaacagcagtattctttgacctcactcttcatagccaaactgctaatcttgggtaaatataagattatattactaatccattgacatttagcagaaattagttatcaaatgggccagttgttactgttggaaacttatgaaaatacattaaaattcttcccatttcctgtatgtttctttctctgacacagaatcttagagccttttattaggctgggagaacttcccaaataatctaatgactagttgaataattgtctatgatatcaaatcagctttgttgtcaaaatgattacagtttcagggtcacagttaatagaaaaatatttaagtgaaggttaccattctcgttgtaagtatcctttgattcaagaagtgaaacttttattgaaaaaactgtttgcagagctggttccctgatggacctttctgaagtttttaaaattaagaaatcctatctctacttttaacaagacaggaatgttagcatattcacccagactaaatgaatgagtgaatgatcacattacacatgcttaggatttgatttccttcctctggtgttccaatagactagcagcttcaggactgaagtgtgattgtaaaattacacatggtggaattcaaaatggtgtacatcagtcaggtcctggcaagacacacaatctaactcagaagtttcaagagactttaagggaaatgtacaaaagtatgggtagaattaaagtaactagcaaggaatgctgaggcacccaggccctagctgctatgagaagctgttatctcctctgggcctggagctgcagaagaaggaaactgtagtcctgagagagctggagtcatggaggaggggttctgtgacagaagctagagttctggagagacataggctaggccagagcataggggaagacatccctgacctctccgtcaaccttctaatcgccgttgttcaaacccagtaggaagttagccagcattgagcctgtagagtcagcccacagcagtcagcctcctgagtgcagagcagaggaagacctggagtggatatgccataggaggaggaccaaatagagagtaactagaccagatgggaaatgctattttagacctcatacactgccaaaaaagaatggcatattcaaggaacgcagggccttgacctcatttgatcttggatttgcatccattttgtgatactttgttccaaatacccttgtaagcatctgacagcagccaggagaattgctggtcagttcagcctgtcccagcttcatcgctgaggtaaatatgtgtttaaggagccgagagggctggtctgatagctcaccaaagggggactttcccaaaggtacatatgtgtttaaggagcagagaggctggtctgatagctcaccaaagggggactttcccagggaaaataaagagaaaattcattgagaatctgtccagaaaggacagtaagtaggcatgaaatgatagtagtaaggaagcatggaggaggcaggtgcataaaaatgatttctgatgtttttgaagctatgtgataacgttctgatccacactcttaccagcctctacaatcttctggaggcttcattggagagcaggattggtatactgtttattacaaatagtgtctgaagacctaagagatgattactgtcagcataagtggagatattacacattgcacctatctcccagcaggaagtttgtttgtttgtttgtttgtttgttttagacagagtctagttctgtcacccaggctggattgcagtggtgcgatctcggctcactgtaaactgcgcctcccgggttcatgccattctcctgcctcagcctcccaaataactgggactacaggcgcctgccaccacgcccggctaattttttatattttttagtagagacggggtttcactgtgttaaccaggatggttttgatctcctgaccttctgatctgcccggttctgcctcccaaattggtgggattacaggcgtgagccactgcgcccggcaggaagtttgtgtttaatgtccctgttgtttcaccaatgtaaaagaaaatggatatttttaaaagaaaagaaaaaagatatcacactgtgtgatgaaatttgtatctatgggtggtcatttgctacttggtaaataattaaagtctgtactggttaactttcctttagcagctgacaacaaataaacatccttacctcccaccttatacactttactccatggttcattgtcagtattattttgtacttctcttgcttcatcatactattgcctggcaaaattccaacccagatttaatcctgcttcccatctatacgctgcctacacctgagagctcaatgttactgttgaaaatgcacactgtggtggcttgtttcagtttaaatgcatgggccgtaacctcactgagccatttattagtaatgactggtaactcctccatatttctctaatccactcactttcgtagtctcctggacaactatgttatagctcctctctcctcaagccttcaacaattatttctcataccctatctctgtgcaaataaccttttttcctatttcactgcaaaaagcccagaagtaatcaaaagtgaatctacatgctcccaccaccacatctactcctcccagtctcagtgaccatatggtttgcctgccttctgttaacagagagcttctatctccacctgacactttatttccctcttgcatattcagggacattagctcagcaattttctttctttctcctttcttgtattatttattttctccctccaccagatcattgcaactgccatataaacacactgaaatatccctgatcgtatttttaaaaatgacacacacttgttaatcctgtgccttccttcagctactaccacatttttctgtccctatttttaacaaaacttactgggagagttttctatactctattgattatgatgggacggcagatggaaactgcttggctgctgtgacaatggctcaccctatcccagttgctacatctagtagcagatcctcaattcttatcttctttgacccatttgatcacccactcttctttacttggtctccacgacactacactttcctgatcttcctcacacctcacaggtccttcttgtcagctccctctgctctttttgctccttaccccaacttctgttagaatgacttaagaagcacaggcctcacacctatttttttttgtacacctctacctctattagcactcctgctcctattttaggaatccaggctttaatgctaacagttacaaattaagccacaagctttgtaagtatttgcctgtgctctagctgctagtgggtttttggaaaatcaatatttgataggcatttgaatacatttgctcttgtggctttaaacaatgtctgtaaaataaaaacttaagaatttacctcctctgaattctagacatttctattcaactacgtagatggcatttccacttgcatgccttaaaggccctcaaccttatctgtactgagttgatcaccccactaactgcctcatccgtcaattatccccattgcagttggtgacattccatcatttggttgcttcggttaaaaaatgttggagttcccccttgactcccttctttctctcatttcctaaagccaattctttggcaaatagtaaccatttctcatgttttcccctgctactgtcctggtccaagccaccatcctcattcacttggattattgcaaaggcctttacctattttatctgcttttatatttgctcatttttctccctccacctctatattttgctctcagcacattatatcatctcatgcgtctactcaaagccttctaatgccttcccttttcataatggcctgtaaggccctttgtgatatggttccctgaaatccttgacttcatttgggcagatgtttctgttacaacactatttatgtgttctgtaaaaccttttgttacacaagatgtactttgaaaaataacagggcttatggtaaaattacgattggaatagagcactcatatcttatacaacataaaaaactatagtactaaccaaagcaataatagataccttgggagataacaggcaggcaggcagctcagattgactgtaggcaattcgaggaatattaaaaatgcataaaaacagtagcatggacatgctgactggggagctgagatgaggcagatgaatggcgctctgagccagagggcctaccactaaggtggtcataggaagaagttcagcctgcattgagcagatagctttgcctggtgggagaggacatatttcttgggagacacctctgggtgcaggcactcatctttagttcccttaagagagctgaaatcactgcagtctgtgcagcagccaacttcagggatttttcctttcctgataaggttataattctgttcttgctattcttgctcctcttgcctaagaaaaatcttgtttccatgttataccaatattatcccactatttaccaatagcatatgagctgcttgctgtcacagaaacacatgccgtaatatgctgtaatagaacagactgtaatccttgggtcatctttgctatttcccatgtgtcaggtgagcacccaccttgtgacttttgctactggtcttttcctacctggaatactctccctccagaaatcttcatagatttcttcatctatgtcagatctttatttaaaaatatttttcatagtttgaacctctctacctagctgatttaaaagaacaccaccaccccaacaacattctctactttacatcatagtttaattttctccgtagtatttatcatctgatatattatattactcatgtattggctgaaccacatccataaatattaagatccgtgagggcaagacttgtgggtttttaaacttgttttcttcctttgtttttctctattatatcttcagtgtctggaacaaggtccagcacatacaaggcatttactaaatgttgagtgaatgaatgaattaagctcaaactccattacagtcctctgggttttttttttttttttttttttttttttttttggggggggggtgtatgtattttgtttttttgtttgttttctgtttttgtgagctgtcatctggcttttttttgttgtttttgttagataataatttgtcttcctttatttactgactttgtttttatgtcttccttaggatgcatcagagtttcatgctgttcacactatacttggggatattcagacatttaaagtcttaatatttcagcaatacattaaaacttctggcctggaaaaatactgtgatacaggttgaatttatctttttgcacccctctgtcatcataaccactccctgctccctcctgttctaggaatccaagctcttatgctaacaattaaaaattaagtccacagactgcaggtaaaccctatgcttgagctactggtgggttgctggaaaattaatatttgatggaaatttgaattaattgtctctttaccccccctaccaatccctgtgtatggtcaaaaaataggacattccaatactccagggtgatggccacagtgctgaggttataaaggagcaggaagatggtaatgaactccctctggtactggacaagggtggtgatgaaaacaatgcgagacgatggactcaggggttctcaaggcagagaatggtgaggggatccaggaatccacatattcaaagacacaaagaagtacagatttctgatgtgttcagggaatggcaactcattagacatgggggcgttggggcacagggtaggcagagaagagagcagtaggtgtatatgacatgaagattttggaatcgatccaactatacagctatcaaaggtttttggtgatacaaccagattcgtcttctcactccttacctctctcacctgatccctctctggcttttccaaactgtcaactataaggctgtgtgaccagagagcatgcccctggccacagtactcagatgagtgcctgacatatatatagagagaaaatcttcttgtttatgtgtctgaacaaactattaatattcatttctgcattttctttacagcaatacttacactgtcttcaaatcctttagggccctgcacctgactatcaggctgcccattggaaactaactttacagactgttcattgattactataatggcatgagtaaccattcagtaacttttttttttttttaactagaattgaaagctttgatccattctctttttctggtgtcatttcccttctgccaggtctgattcatggtgcaacttttggtggcatcacccccaactccagcaacatttttgtccaccctgaggttattactttgatgtcctgaacttatggctctgggggatattttttttaagggatcagagagataaggttgaattagagagattcttagaagtttatgattaaaacactgtcccctctgatctgagtcccagctctgccattgacaggttgtatatcattagcaagctccttcacatttctgaatctcacttgattgagcaaaatttagatctcaaagactactggagatgtgatgctttcacacaaagaaatctacctctttggtgaaatttcaattgtttaggagcaattatttggaagaaaagtgccctctcaccttcttaaatcatctcctagggctataataggaaatatgcagcttttgctgagaacccaaatgacattgtggattatccagctctagtcttctctctcccatatagaggtcggttatctttcccacttcagcagcccaactcagggccatggagaggaaatagatgagatgaagcttaaatatgtcacattagttatttcttagcagctctgataaaagctttagcaggggccgggcgcagtagtgcacgcctgtaattccagcactttgggaggccgaggcagcggatcacctaaggagttcgagaccgcctgaccaacatggagaaaccttgtctctactaaaaatacaaaattaaccaggtgtggtggcacatgcctgtaatcccagctactcaggatgccgaggcaggagaatcacttgaactcaggaggtggaggctgcggtgagccaagatcatgccattgcactccagtctgggcaacgagagcaaaactctgtctcaaaaaaaaaaaaaaaagaaaagaaaaaaaaggttcagcagggtgaggttaaaacttgattaaagaggtctgaggattatctgtgatgttaactcatgtatgttgccttcctctcttcccttctttgttctagggattagttgactttgttctagggattagttgttctaggaatttctagggattagttgactgcaaacattaatgggttaaatataaaaaatcttttctatcctgaaggtccttgaaaaaaatgattttattacttaccggaaaagaaaaataaaacaaagtttacttcacccagaatttatttattttttcttctagtaaaaatgagcaacttctttaaccagaactgaccttgaagacaaatggctaaaataaaacatttgctgaattcactgggcgcatcttacaagtaatttttggattctgcattgactgcctacaagtgccttctgggtacaagtccacagacaagatttgttctgcaaatcttccatgaccaaggtcacctctttggattggcagacccagggagtccatgttgggaagataaattcacacttcatcccttgttgagatctccagccttgctcctctgataactaaccaggtctttcttctgtcttattataatttatgacttttgaaaagtgaattatatctggggttactcaaactctcagctatctataaccatatacagaaatggttctagattctttaaaaaaaagaagctattcagtgatattgggatactctataaccaatataaatggataattcagcacaccaggtgctggggttgagaaatagaggtgaacaattgaggcagggccaaataaagattggaggcaaagacagtgactagatggggatctctgataaggtaatgcacaggcctgtccttggaattctgccacagtggggacattagtgggagcctgtagtcattgcagggtgagaggaggatagaaagaaaagattgtgtgaaggtcagtggaaggtcccccatttcactggtaagagaactatgtatgcaagttttcctgtgtttagtctcacacatgtttggacctttaagaactgatcacgtaatgcatttccctgacagtttttggcatctcagacgaggaagagtgatgggcgacaggtgatggtgacaactattaataagatctgaaagcaaacagtctcatgaaaggtggccaggagagggcagtcaccttttttcaagagtacagactgaatttgcaaagagtacttaggctacaaggctataaagcatgatgcaggcttaagtaaaatgcagtgtcttgagcatagtagaatcttagtgtatgtttgctaaacataccttagctgctgcttttccccagagctcatcagagttccatagaaacctggtcccttccagaaaaccaaagaatgactctaaagaaaagtgattgcaaatccagaaagcagctttgccttattggttggtaacagcagggttttctttcccttgtagtttattttggcttaggctagtgtctctttcatgaagacagctactatttacaattgttgttaacatgtttttccttttcatctcccaatatactctcttcctgtcattaaactcagtcaatttactaatggaatctgctttataagctgctgcattttctttttccacagatgggattaaagccattatgttctatgtcatccaaatagtgttagcttctaggcaccaaggtgttgttccagaggaaaggagaataatggtggacacaggcaggctgagggctaacctaatgatttcatgcatttagtggtaatccttaattaagatcccagttttattttgttggatttagtctgtaacctgctggaaatcattcttgaattaacactgggtggttataaaagcagtaagccaaggagtttgcacttttttcagctgtagctgtttatttagctggagaaaatttagtgggtggtccaaccttcataaccaggaagaatagaatagaggtgtaaaggccttggtggaaggagggcagtagcaacctttccatttcttcagttttatcacagcttataaaattagttcattaggtatgttgatcttgtaggagctagtattttaacatttgccccatgaagttgtttagtttaaatctaagaataaacccactgaaaactattcctaattcacaaaatgaataagaaataatagatgttaatagaaacaaagacttcatttggtttgtttttagagggggcacagaggatgtagtaatataataagttagatttttgttgttttctttgtctttgttctttgtagtcattattatctctaattggtatttgttcctgagttttctcagcgtgcttccacatgggagagataaaagtctcaaagctggtgtacaaaaacccttaataaattgcccattaattagccaccttgatttccacctttaaagcagtttagtgaagtgagagtttgttagatttttctcaagcatagcagaaattaagattaacttcttaggtgtcattgctacttgcctacttaaaccagttcatctttatcataaatatttaagccaaaaatcacattagaggcaatatggcacagtgactgtggactccggagtcaggtgagctggttgaaatcctggcttggctacttcccagctatgtgaccctgggcttcagggttcccttttgcaacatgacatgattgctgagcttctccttagggttgtgtatgactccaataagataatacatgaaaagagctgaaagcagtatctgaccctggagagaaagtagggaagagacaatgaaggaaggaggaaagaggacaaggaagtgggagatagaaagaaaattcaagaaggaaagtggaagaatctcaaatagaaaattaattttcagtttttcctgagaagagatatatagacatgttcatgtggctttggagagccttggagcccatcagcaagaggtttggaaattacattgaaacagaagtgtagacctatgtgacttatgtcctggccagttgcctcatgtcctctgtggtcagattgatctctattggcactgtcaaaggattttttatggacagctggttggggtaaactttgaaacctgattgtttgcacttgagtgccagaatgtgtaattatttactggtgttcactaaggatgtcactgtagctttttagggggagaaagaacttaagtttaaaatttggaggcatctttttcagtctgcctgccctggtgtttgttataacacttagtttggcatgtaacagctgaacctactggttaaatcattaagcatttattattttaaaactcatcttctcaaagcgaaaaataactatcatgttgaagttctttcctctaagaatgacatttactgtgagttttataccaatggactaattgaagggttgagaaaataaattttggaaagacaacaataacttcagaattttccttggatggaggttttctttttaaaacctgaactgagctttatcaaaacagtaactgaactttgaaatgaaacaagagtgctgagttgaaagctccaggaaggcagggatgtgtctgcgttgtttatgactataacctctgggcctaaatcagtacctagcccatagtaagcactcagtaaatgctgaatgaatgagtacggttttaaaattagcatgactgttccttggaaaaaaaataagtcaaaagggaatagcatgcatatgtaactaaatgtttgaaatctcatcacttttttaaggtcaggacctgtttttttctgctccaattaaagaagaaaattgtaatgtaaaagaagcataaagtgaaatatttggtatttatttgttttgacatctgcaataaatttaaaataaatttgtaaatcttattgtattgaaattgtatgagtttcttaagtggtattattcattcagacttaaagtgaagttaggttgctgtcattcatagtggacatttttttttcattattaaaacaacaggtcgtctgggtgttgtcttgtattacagaagcttgcgtgttttctcttgatgctgtgccgtttctattgccattgaggggtctaaggaccaaatgaggtcttattccctttctgatatattcttttggccagtttagaatatgccaggtccattcacatgactaactggctcagttctgtcagttccctcgtcttctcatattagattgttatccatgagcttgaagtttagacataaaaaagaatggttataattctcttccttcactccccctcttccctttttttccttaaagttggccttttgaattcattattctaataattaatattatatattattatataatatagtatatattcataataatgattaatgatagtattaataattgtgtgtgtgtgggcggatactcatacagaggaaaacaatgagattgattggtggaaattacattaatttcataacctcttattaaaagagtttgtgtgtgtgttgttgcttgtttgttccctttgcaactcaaataacatggtcttcttgaggtgcagggaaaacatatgcttaggaaacagagcctccttttccccttttggtatgaagacatatgcaaaaagaatgaaggaactcattgtctctagccagggcgctgtaaaaatagtactggtagagaaaaagctctaagagaagtaaaagtttatagtgctttctcctggcagagttaacctcatcttcatcagcttttcccctgcctcagagaggcagttttggaatgaccaaagcagagtgcgcaagctctctgttcagagttagctagcgtttggatcactgtctctctctgccacagtatgagtggaatattgcatgaccatttctgacttctacattgagcacactcggcctagatgaataaatcctccttgaagaaggtggggcattttggcattcacaagaaaccaagttgatatctgatcctcccactggagaaatgtggcaaagtgagaaagactcactctttgggactctgaaaatataaacacaaataaaaattcaagctgaagaagtcacttgaagtaaaaaaaaaaaaaaaaaaaaaaaagtgttaaactctgttagtcatgtgactttttcttggcattcaaggagccaggaggctcttgtggtctaatctggaaagagtcgctaatcgctgtgtcaccctggcaaattggttgatctccttgtgctggagtgtttagtccagctgctggatgggatgaaagcaagacctcactgaaaccagatgctgtctctctgaaaagatttcagcaataaataatatcatatatactttgttcctggcggcaaatactgaactgttataaccccctgttttcacttgcttctaaatttctgaaaatatctcctttgggcttgaatttttccatgcttttcttcagcccaaaactttttggaaagtttgaccaaaatttcacttagctgtttttcctgaattatgggagaataaaggcattgcattgtttttcagctcataaattctaatttttcccattatacctcagaaaaatagctgagctgctacttttaaagtgtttagaactagtaaaagaatcttggtatggtaaagaatactggcagaagacaaatttaagtctctcagtatttctttctaactctaaacatgaccccacacaaccaggacacacataaaaagctctggtatagttttatagatgaccaaagagaagattctgcaaattctctcagtaactcatcccaagttaccaagaggcaactttagctaccatcagttgcacctttcttaaccacttgctctatgtctgtggatctgatttctaaaaagatgtcatggttatatgctggcattaattgaccctttgtctatattttaattgaagttgaccatttcttttaggtagccttcatgtgtgatgacctcagtcacatctgctgacctagtagactgaaaactcctttacagcaaggcctacgtctgtctccctcaccattgactctgcagtgctcagcagggtatcacgcatgtagtaaaaactgattattgaatcaattaaatgaccataagtacaattgtttttactgcagttttttcattgatttgtccactaagatatgcatgcatgtgttgagtgagtatcactgagtctctactttatgccaggtattggtatgaatgttgtgaatatttctttgctttgatgggtgacacagaagtttggggggattaattaattatacacaacaaaataattatattatttgaatacaattactatgcctatagttggaatattagtccaatctagccaaaaccaatcccagggaatttatcacttactgagcatccatgatgtgcctggccctgtgttaggtactgataagagatcaattagaccagtttatgcagaaagacacacataggttaacagtggcaagacaaatcctaaagtacctattatacaagggaaactataataaagagccaggtgagttgaaagcaggagaggtatcattgtaccacaagatacctcgtgatcttgtgtaaatcccctgaacaatcagaaaaagcgttatggcatagctttatggtcatagatctcatggggacaggcagttcattgcaattccttttatagccgcatccttcactctttaaccctgcactgtatgccattcattctctctgtgctttcagccttggtcaaatgtctcaggactggaaaataaactggaatgacactcaggcacttgatatcaagattactagggtcatgattgtatgtataagaccccaagacctcttgatggttttacaagcatgggtactttttttgtacctatgttttcttcttttgccccaagttcaagagtatgttacagcagcagtataagcatacacaatcaaaggtgattgaagtgaggaagattggctcaatgagctccagccacttcgactctccttctagtccctaacccaccaaactaattgtccccttgcctggaatgtttcaccctcagattttggcatagcaggcttctttttgtcattcagatctcagctcaactgcaagactttctctgacctaaagttacatatgagtcaccccttctggtctccgttgctgtctatcacatcacctactgtgcttcctttatagcatttatctccacctaattgtgtccttctcagtgtttttctttaaactttttattgtcagttttctttcactagatgtcagttccatgaagtaggaaacctttaccaccggtcttgagtgctctggaaagtgtatgtgtgcaataggtgctcaataatgtttacgaaatgatcagctggatgtacatatggcaagtggcaagaagccaagggaataggtcaaaagtcctattgtgctccttgcctgaacaaaacctcttgcaagaatcataggctgttcttgagggtgcctttgccttggattcagcccaaaattctcctatttgttttgtgtgagagttttcctcccatacacagcaatgggcactaagaatgcatatatccagacttttcaagttacaggatggcatctcagatacagtcttcctttggtctatatactatgaagtcataattgcttaagccagtgtctttttcaggatttactccgtacttcttattcgaggcctttcaggtggccactgccctggctttcagatataatttagaatttagcttcggatttgtaaagctattcatgttgcagatcttctctgaaacatttctgtcacgttttggaaagctttacattttcttttgctaatgattttcatctgccaaagagctcatctacttaaaaagcagatcactgaagccacacttggcacatattactttggcttattttctttcgatttttttttgcttttctgggataacttatttatgaagaaagagagaacgctgactttttaatttagaagagaggatattacttgcgttgagagttctagttatataaaatgtatttatctaagttgttaactatatcaaaaatggagcagtcaatgtttggaaatagttcggggtgaaaagattttagcgtgttcacatattctcttagctgtttttaaataattttgcaaagcttatttgcatttcccaaattaacaattttgaccaacaggaaaagctaaagtgttggtttttctcagctcaactttttgggtgtaattaatttataagcaggattttatgaagggagaacagataggacctttctacaaagtccctgagccaaataaacaccccattgttccatagttttgtattgcacataggaaaacatccatccctatcatttttctattaaagggacacagattaccagatttgtaattttaaaaaaggccatttgttgattgagccactttgcgtataaagggtggtatatgttgcctgccaaatttctgtcaacacaagaagaaaaatcatatatcaaaaaaaattttttctcatatcatgtaagaaatttatgcattttagtatgtaccagaagaaatggcataggcattttctgtttttagcagtctattgaaatttcttgattaaagacattttctatttgaaggttaaaatgaccatataaatacagattaattcagttttaatagatgcatcttcctgtcatttaccactttcctccctcaacatcagctgcagtgatcaacatatatttggcagtgaaaccgatatattctgtttatcttcaaatcataagctttttgtttaaatacaacggaatatcttatacctctgattttaatatgacaaatcaaaaagtccacaccaaacccccaactcatcccaaaaaagagattgctatctactcattactgttcactgcttccaagatttgtttcccttggggttactgtttgagaaacttttcttacttccaagattatttttctggttttaagaaagaatctgaactccaagatttttttgtttgtttgttttcagaaagagtctgaaaatctagagattgcttaccttgtggtgaggtggttgtctatgcctctgttcaacaaagtcctcatatactgaatggaaaaaaaaacatcagggcctataattttctaagcattgtgcaagataatagaggagacaaaaatgatgtcttgcttcagaagtcttagatctatttctctttgggggttgaggaatgagaaagattttcagatgaaacaggaagcccaatgaggattatgtggcaatagttcctaaaatgagcaaagagataaatttacttttgtatatgattacaaccaaatcacacactggtgagtttcaaaacagtagttttcatttagaaagcaaattaagtggaataattcaactgagtttcactgcaatgggattcattctagatggttcaactgtggaattagaaacaatatctaaggatgttgctgatagtagtcagctgatgaataccagtgagccatatacaggtatacataattttattgtgctttgctttattgtgttttgtagataattgtgtttttacaaattgaaggtttgttgcaaccctgtgacgagcaagtcttctggctccatttttccaatgacttgtgctcatattgggtctctgtgttacatattggtaatccttgcaatgtttcaaacttttttattattattatatctgttatggtgctctgtgatgagtgacgtttgatgctattattatattgttttagcacactatgaattgcacccatataaggtggggaacttaataactaaatgttgtgtgtgttcttactgctccactaactggctcttcccttatctctctccttctcttctggcttccctatcccttatctctctccttctcttctggcttccttattccctgcaacacaacaatattgaaattaggcccgttattaatgctacagtgacctctacatgtctgatatggtatagttgtgtccgcaaccaaatctcaacttgaattgtatatcccagaatttccatgtgttatgggaagcacccaggggaaggtaattgaatcatgggggccgatctttcccatgctattctcgtgagagtgagtaagtctcactagatctgatgggtttatctcatgagatctgatgggtttatcaggggtttccacttttgcttcttcctcatttttctcttgccaccaccatgtaaaaagggccttttgtccccagccattattctgaggcctcccaagccatgtggaactataagtccaattaaagctctttttattcacagtttcgggtacgtctttatcagcagcatgaaaacaaactaatacggtaaattggtaccagtagagtggagtattgctgaaaagatacccaaaaatgtggaagtgactttggtagtgggtaactggcagaggttggaacagtttggagggctcagaagaagacaggaaaatgtgggaaggtgtggagcttcctagggacttattgaataactttgaccaaacagcctgataacaatatggacaattaagtccagactgaggtggtttcagatggaggtgaggaacttgttgggaactggagaaaaggtgactcttgttatgttttagcaaagaaaccggcagcattttgcccttgccctagagattcgtggaactttgaacttgagagatgatttagggtatctggaggaagaaatttctaaacaacaaagcattcaagaggtgaatgtttgggtgccattaaaagcatttcattgtgaaagggaaacagagcataaaagttcagaaaatttgcagcatggcgatgccatagaaaaggaaaacccgttttttgaggagaaattcaagccggctgcagaaatttgcatgagtagcaaggagcctaatgttgattcccaagaccatggggaaaatgtctccaagccatgtcagagaccttcatggcagccctcccatcacagacccagaggcccagaaggaaaaagtggttttctgggccgggcccagggtccctgtgctgtgtgcagcctaaggacttggtgccttatgtcccagctgctccagctgtggcggaaaagggccaacatagagcttgggctgtggcttcagaggatggaagccccaagccttggcgcttccatatggtattgagcctgcaggtgcacaaaagtcaaaaactgaggtttgggaacctccgcctagatttcagaagatgtatggaaatgcctggatgcccaggcaaaagtttgctgcagggtcggggccctcatgaagaacttgtgctagggcagtgcagaaaggaaatgtggggttagagcccccacacagagtccctgctggggcactgcctggtggagctgtgagaagagggccgctgtcctccagaccccagaatggtagatccaccaacagcttgcactgtgctgcttgaaaagctgcagtcactcaatgccagcccatgaaagcagccaggagggaggctatactcggcaaagccacagggtggacctgcccaagaccatgggaactcacctcttccatcagtttgacctggatgtgagacatggagtcagaggagatcatttttgagctttaaaatttgcctgccctgctagatttcagacttgcatgggccctgtaacccctttgttttggccaatttcttccatttggaacagctgtatttacccaatacctgtactcctgttgtatctaggaagtaactagcttgcttcttattttacaggcttataggcagaagatatttcccttgtctaaagtgagactttggattgtggacttttgggttaatgctgacatgaattaagactctgggggactgctgagaaggcattattgcttttaaaatgtgaagacatgagatttagaggggccagggccagaatgatatgctttgactctgtccctacccaaatctcaactcaaattgtatctcccagaattcccacatgttgtgggagggacccagggggaggtaattgaatcatgggggccagtctttcctgtgctattctcatgatagtgaataagtctcatgagatctgatgagtttatcaggggtgtccgcttttgcttcttccttatttttctcttgccgccaccatgtaagaggacccttttgcctcctgctgtgattcggaggccttcctaatcatgtgggactgtaagtccaattaaacctctttttatttccagttttggatatgtctttatcagcagcatgaaaacaaactaatacagtgtccaagtgaaagggagaatcacaagtctctcagtttaaatcaattaagcttagtgaggaaggcatgttgaaggccaatataggccaaaagccaggcctcttgcaccacagagttttccaagttgtgagtgtaaaggaaaagttcttgaaggaaaataaaagtctactccagtgaatacacaaatgattaaaaaaaaaaaaaaaaaaagaaaagaaaagaaaaggaaagaaaagtgaaacagccttagtgctgatatggagaaagtttgagtggtctggatagaaaatcaaaccagccacaacatttccttaagccaaagcctaatccagagcaaggccctaactctcttcagttttatgtaagctgagagagaaagctacagtagaaatgttggaagctagcagaggttggaagtttaagaagccatctatataataacataaaagtgcaagatgaacctgcaggtgctaatttagaaactgcagaaagttatccagaagatatagctaagatcagtgatgaaggttactaaacaacagattttcagtacagacaaaatagcctattggaagaactaagactttcatagttaaaaaggaaaagtcagtgcttggcttcaagacttcaaaacttcaaagggaaggctgatcctttttttatgggttaatgaagttggtgactttaagttgaagccagttctccccagccttgctagagagacctaaagtcaaattcaggaaatacagagaacctctgcaagattctacacaagaagatcatacccaagacacgtaattatcagattttccaagatgaaaatgaaagaaagaatgttaaaggcagctagagagcaagggcagatcacctacaaaaggaaccccatctggctaacagcagacctctcagctaaaaccctacaagctagaagagatggggggtctatattcaacattcttaaagaaacaaatcttcaaccaagaatttcacatccagccgaactaagtttcctatgtgaaggagaaaaaagattcaaagcaaatattgcgggattttgttactaccagacctcccttataagagatcttgaaaggagcactaaatatagaaaggaaagacagctaccatctaatactaaaacacgcttaaatacacagaccagtgacactataaagcaaccacaaaagcaagctattataataaccagctaacaacacaatgacactaccaggttcacacatatcaacactaaccctgaatgtaaatgggctaaatgcctcacctaaaggcacagagtggcaagctggataaaaaagcaagacctaatggtatcctgtcttcaagagacctatctcacatagccttaaaacaaaggggtggaggaaaatcaaccacgcacatgggaaacaggaaaaagcaggggttgcaatcctaatttcagacaaacagactttaaaccaacaaagatcaaaaaagacaaagaagggcattacataatggtaaagggttcaattcaacaagaagacctaactaccctaaatatatatgtacccaacacaagagcaccgtattcataaggcgaggtcttagatacctacaaagagacatagactcacacacaataatagtgggagacttgaacactccactgacagtattagacagatcatcgaggcaggaaattaacaaagatatttaggaactgaactcaacattggactaaatggatctgatagacctttatagaactctctacctaaaaataacagaacatacattcttctcatcacccacatggcacctactctaagactgatcatataattggaaacaaaacaatcctcagcaaatgcaaaataactgaaatcatacaatttcaaaaatcatagggcccttaagaattatgctaaatctactctgtctatagtctataaatggaacacaatacatgtgtaatagtacacctgtttacattatggcttgctgaatattttaaggccacagttgagacctcctgcacagaaaaagatttttttttttctaaatattagtcctcattgagaatgtacccagtgaccaaggggctctgatggagatgtacaaggaggttaatgttgttttcatgcctgttaacacaatgtccattctgcagcctatggatcaaggagtaattttggtctttaagtcttattacttaagaaatacatttggtaaggctatagctgccatagatagtgattcttctgatggatctaagaaaaatacattaaaaaacttatggaaaggatttaccatccaagataccatttaaaacttttatgattcgtaggaggaggtcaaaatatcaaccttaacagcagtttagaagaagttgattccaattctcatagattactttgaattgattcgagacttcagtggagaaagcagctgcaagtgtagcggaaatagcaagaaaacttgagttagaagtggaacctgaagatgtaactgaattgctacaatctcatgataaaacttgaacagatgaggaattacttcttatggatgagcaaaaaaatagtttcttgagatggaatctactcttggtgaagatgccatgagcactgttgaaatggcgaaagatttagaatatgacataaacttagttgataaagcagcagctagatttgagaagattgattccaattttaaaagaagttctgtgggtaaaatgctgtcaagaagtatcacatactacgcagaaatcttttatgagaggaagaatcaatcaatgtgacaaactttactgttgccttattttaagaaattgccacagccaccccagacttcagcagccacccccatgatcactcagtaggtgtcaacattgagacaagactctccaccagcaaaaagattatgactcactaagggctcagatgatcattagcatttttagcaataaagtatttttaaattaaagtatatatattgtgctttttttagacataaagctcttgcacacttactagactacagcaaattataaacataacttttttttaattttttattttttttgagacagagtcttgctgtgtcacccaggctgtagtgcagtggcgcgatcttgtctcactgcaagctccgcctcccaggttcatgccattctcctgcctcagcctccctggtagctgggactacaggcgcccaccacaacgcctggctaattttttgtatttttagtagaacccgggtttcaccatgttagccaggatggtctcgatctcctgacttcatgattcgcctgccttggcctcgcaaagtgctgggattacaggtgtgagccactgtgcctggccaaacataacttttatatacagtaggaagccaaaaaattgtgtggcttgctttattgggatatttgcttccttacggtggtctggaactgaactgcagtatcttcaaggtatgtctgtattcaagtttatattttcacatacattcttctttacttgttaaaatcatggtcacctcgttattatatgactcattagaatttgcacggttgctttgaccgtataccattgttctacgactacacagatgtctgagtcccaaaggtgaatctgtctggccaattctgaatttaacagcctatataaaaagtagatgttacacaccttgtataacagaagccccctatcatgaacacagcttaactcttgggtgggtcacttagtctgcttggttgagattttagtgcttttcacatctatagaaatgtcctatttgtctaaggcaattttttgaagtaaatttattcttgtcatcctttccgacctgaatatagaggatatataatttttaacattccattattacctaggggatgctcttcagtcattcttccctgaattgattgcactagccctatctttttcacctgaaataagttaaatgtagaattagcactaaagagaaatacgatgaactccttccagaatgggaataggaaatgaaagagagtaaatcagaagtgaatcacttttttttttttttttttttttttttttttttttttttttgctttgcaaatctatattttttccagctttatttaggtatgactggcaaataagagttgtatgtattcaaggtgtatgacatgatgatttgatatatgtgtacattttacagtgatcaccacaatcaaattaatacatccttcaccacacagttaccatttgtgtgtgtgtgtgtgtgtgtgtgtgtgtatgtgtgcaagaggagataagggagtttaatcatttttgaacactagctacaacacaattcaattaaaattctgagaaagaaggaaaattgtcatgcagctgtttaattttagaagcattaactgacaaaatccaagtcttatgaggaatactcagtccaattttcatgaatgaatgggagcccttgcctctgaaattgttgtcatggaagaaatgctaacactgtcttacacaattattcaacttaccaattgaattaaagtaacaagatgagccatggttgtaactgagaatggcaactaaggtcttcttatttaatctgctacctagtttgcctttttgctttagagtggggactatgtttgaattcaaagaataaaagacctttatcctttcaggggagatacaagtaacaagtttaacttttttttttttttttcttaacactgacgcaactcatttggggctgtggaaattgctgctagcattgaaccccttattaacattcaaggtgtgccagttttgcacaagctgtgtcatattcagagacagattgttggcacaaactaaggcacttattctcttgttttttcacctctttcaataagaacagataaatataataaatatactatttctagataagcagttgaaactgctctgctcatctctttggaatacatttgtgcgggatattactgtatgacatgcagaatatataaatatacaaaggaaatgcgcctgcatacattgagatataaatggatgcctattttagaataatatattatttcttaaaagtaaaataagttttggctggtcgcagtggctcatgcctgtaatcccagcactttagaggccgaggtgggtggatcacctgaggtcaagagttcgagaccagcctggccaatatggtgaaaccctatctctactaaaaatacaagaattatccaggcatggtaatgtgcacctgtgattccagctactcagaggatgaggcagggaattgcttgaacccaggtggtggaggttgcagttagctgagatagcaccgttgcactccagcctgggcaacaaagtgagagtccatctcaaaaaaaaaaaaaaaagtaaaataagttttttaagtcactgattctgtttctaaggaattctcagctggggcttctgagttaattctcgatggttagcacttatgagtagcagaaaagaaaactactgtgaattttctctacaatgatttaagacagtgaatggggctttctggcatgtttgcagttaggaactcagatgaccatagattttttttttttagactgggtcttggtcttactatgtcacccaaactggagtgcagtggtgtgatcatagctccctgcagcctcgacctgggctcaagtgatccacagatttttgaagttcaccctggattgttgtgttctatacagaggttctaccttttgctgccttttatggttgctgtattattattttgatgtttcttaaccagctgaatcacattgtagtatatgaaatatgttttggcccttgttttaatggtcatttgctagcagatttcacaatggcccacttaagtaaaatgtaccaacccattcattgctatttgttgcaattcatggtgactaaacatgactccatggtgcagctcaccaaagtcttggtttatgtgtgacttccaggggagagagattgagaaccatctgttaatcattgtgtccctaaactagagtttttcactagagtagttgggcagttgaattagtatgtttctcgtaggctagtgagaaaaacagatttttgggggacattaatcagactctgctggcccagacctctgggaagccttgtgacaagatccagcctgtaaaatatcacatatgatttgcttttcttcttgaaagggacacattgtggcttttctctggaatctgtgaagaaaatgcttctgagcctagaaactggagttgagaaagctcttcctgatcatataacaataagtcttgtgagggtcaccccttgagccatgagggcaggtagaaggaacatggggttgagagtcatggattcagtgattggaactcacttgactaaccagtgtagctctgccacccctcttaggattgttacagtgatatgtgcctacatatagaaagtcatcagaacttctgtttatttttctgtgtaatatttatggacttgttacatttaactctaggcaaaggtatagatttggaggtctttgatgtatatatattatatataatgtattttagcatacaaaggaggctataatacatactcatgtacctgtcacatgaatgaattcatcaaatgtaaacttttttcccaaatctgcttcttagctgttatttataaagaaacaaattatacagaaaaatttgaaggcccccattttaccttccccagtctcattcttttctctgccaccccagagaaaacaactgtcttgcataggtatttatataattctgttttatactttgccacttttactacatatatgaagcatgcttgttacatacatgaacataaaatatacatgttttactgtaagtgtgtaatgtattctagaatttgctactttactaccaaatattttgtttccagaatttaccttgttattatataaccctagttcattttttaaaaaattgccatatattactccatgttatgaaaataccacaatttatttattcccatactaaccagaatttgaattgatacaatttttaattaaaattaatgatgctgaaagaaatgttcttatacatttccctcagggcatacgtgatagagttcttctcacatatatatcagtgtacttgctgtgtcttaggatttgtacaattgcatgtctgttagatacgccaaattgttctgcaaagtactcatacctgtttccactcctaccagcaatgaatgagaactttgtttcccaggtcgttgccaacacttgattattatcagatttaattatttgccagttgatggatatgaattgctctatcattgttttaatattcattactttgattatatataacattgggcatacattttatagggccatttaaatttcctcttatctgaattacttatttctcctcttcattgattcttctattatcttttcttctctttattaatttatagaaatgtgtatatgtgtgatcctaatatatgtcataatacctatgttcatatttcgtatatatgtataaagaaatatttgtctgttatatataggttgaaaagtttgctccctatctgctgattgcattttaattttgttcatgacatcttttaacatacatgatctttaattttgatatagttaatttttttttactctacattttgagaattgcttaagaaatgactttattttgtatagtcatatgctctaaatttttaaatctacttacgatagttttatgttaaatatgtcaacctttgtttcaccgggaatttttttatatgtatggtataaagcataaatcaatttttttactattaagaatgcttttattatattatatcttattttattctatttttatttttccataagttattgaggtacaggtggtatttcgttacttgagtagattctttagcggtgatttgtgagattctggtgtacccatcacccgagcagcatacgctgcaccatatttgttgtcttttatccctcatccccctccctccctttccccaagaccccaaattccattgtatcattcttatgcctttgcatcctcatagcttagcccccacttatcagtgggaacataccatgtttggttttccattcctgagttacttcacttagaataatagtctccaatctcatccaagtcatgccattaattcattcctttctatggttgagtagtattccatcatatatatatgatagaatatatatatgtgtgtgtatatgtatgtgtgtgtgtatatacatgtgtgtttgtgtgtgtgtgtgccaacagacgtcagggtggcaggtactggggggtccctgattcctgctgcttacctttcttgctgccaatggtccttaaaatccaaacatgatgccctctctgtgtgagcaaatttggggaaccaaaggaaatcaagcttgtaaacaagcagtaaattttcccaggcacaatttgtttttgctccccaaaagtacacagatagaaaattttgtgagatcagaccagtttttagtatttatccagcataatcatttggcctaagcaaacatgtaaaggggcttctttttgaggctcaatgaataggccgttaaagtaaacgattccatctctccagaccccgacacgctcaaattcacttgaagagaaacactttttaatgctgaattnnnnnnnnnnnnnnnnnnnnttgagccgaggagtttgaggttgcagcaagatatgattttaccgctgcgccccagcctaaacttcagagcaagactctgtctctaaattaaaaacaaaaccaaaaaattctactacagcatacgttttatggataaattttacaccaccattgaaacaattataatacaatcagtgcattttggaaaaaaagaaaaagaaaaaaggaaaggggaatgattatattatactagtggtagggtattccctaacaccatatatatacacaccagtttctttatccactcgttgattgatgagtgtttgggttggttccatgatttttcaattgcgaattgtgctgctataaacatgtgtgcaagtatctttttcatataatgacttcttttcctctgcgtagatacccagtagtaggattgctgaatcaaatggtagttctactttagttctttaaggaatctccacactcttttccatagtggctgtactagtttacattcccaccagcagtgtataagtgttccctgatcaccgcattcgtgccaacatctacttttattacttttttttattatggccattcttgtagaagcaagatcgtattacattgtggttttgattgcatttcccttatcattagtgatattgagcattttttcacgtatttgttggccatttgtgtatcttcttttgagaattgccttagcccactttttcatgggattgcttgttttttttttcttattgatttgtttgagtttgttgtagattctggatattagtcctgtgtcagatgtgtagattgtgaagattttctcctactctgtgggttgcctgtttactctgctgactgttccttttgctgtgcaaaagctctttagtttaagtcccaactatttatttttgtttttatttcatttgcttttgcattcttggccatgaaatccttgctaagccaatgtctagaagggtattttccaaaaatactacaatattttctagtattttgatagtttcatgttttagatttaagttcttaatccatcctgagtagatttttgcctaaggtaagagatgaggatccagttttattctcctatatgtgactagccaattatccaaacatcatttgttgaaaaggtgtcctttccccactttatgtctttgctttgtctaaaatcagttggttgtaatatttgggtttatttctgggttctctattctgttccattggtctatgtgcctattttcgtaccagtaccatgctgttttcgtgactatggccttatagtacagtttgaaatcaggtagtgtaattcctccagatttgttctttttccttatttcttgctttggctatgcaggctcttttttggtcccataagaattttagaattgttttttctaattatgtgaagaatgatggtggtattttgaagggggtggttttgaatttgtagattgcttttggcagtgtggtcattttcacaatattgattctgcctatccgtgagcatgggatgtgtttccatttgtttggtcatctgtgatttctttcagcagtgttttgtagttttccttgtcgaggtctttcgactcttttgttaggtatattcctaattattttattttttattttttgtttttttggcagcaattgtaaaaggggttgagttcttgatttgattctctgcttggtcactgctggtatatagaagagctactgatttgtgtacattaatcttgtgtctggacattttgctgaattcttttatcagttctgggaactttctggaggagtctttaggtactaaaatctttagggttttcaagttaaacgatcatatcatcagcagacagtgacagtttgacttcctttttaccagtttggatcccctttatttccttctcttgtctgattactctggctaggacttctagtactatgttgaagaggagtggtgagagtgggcatccttatcttgttccagttttcagagggaatgctttcaacttttccccattcagtattatgttggttgtgagtttgccataaatggcttttattacattgaggtatgtctcttgtatgctgattttgctgagagtgttaattataaagggatgctggattttgtcaaatgctgcttctgcatctgttgagatgatcatgcaatttttctttttaattctgtttatgtagagtatcacatttattgacttgcataaaccatctctgagtccctggtatgaaacccacttgatcatggtggattatctttttgatatgttgttggtttcagttaactagtattttgttaaagattttagcatctatgtttatcaaggatattggtctgtagttttcttttttggttatatcctttcctggttttggtgatgctggcttcatagaattgattagggagggttctctctttttctatcttgtggaatagtgtcaaaaggatcagtatcaattcttctttgaatatctggttgaattctgctgtgaatccatcaggtcctgggcctttttttgttggtaatcccttaattaccatttcattctcactgcttgctattggtctgttcaggttatctaatttttcctgatttaagctgggagagttgtattttttcctggaatttatccatctcttctaggttttccagtttatgtgcataaaggtgttcgtagtactcttgaatgatcttttgtatttcagtggtgtcagttatagcatcccccattttgtttcttaatgaagtaatttggattttatctcttctattcttggttaatcttgctaatggtctatcaattttatttatatttttaaataaccagctttttgttttatttatcttttgggttttttttcttttaattttatttagttcttctctgttcttggttatttcctttcttctcctgggtttgggtttggtttgtccttgtttctctagttccttgaggttttaccttagaatgtcagtttgtgttctttcagtctttttgacataggcgttagagctatgaactttcctcttagcaccgcatttgctgtatcccaaaagttttgataggtttgtcattattgttgttcagtccaaataattttttaaacttccatcttgacttcatttttgacccaatactcattcaggagtagcttatttagtttttatgtatttgcatggttttgaaggttccttttggagttggtttccaggtttattcaatgtggtctgagagagtacttgatatagtttcaattttcttaaatttattgaggcttattttatggcttatcatatggtctatcttggagtaagttccatgcactgttgaatagaatgtgtattctgcagttgttggatgaaatgttctgtatatattggttaagtccatttgttccaagtacagtttaaatccattgtttctttattggctttctgtctggatgacctgtctagtgctgtcagtggaatgttgaagtcctcactattattgtgttgctgtctctctcatttcttaggtctattagtaattgttttataaatttggtacctccaggagttaggcacatatatgtttaggattgtgatattttcctgctgcacaaccttttttaccattatataatgtccctctttgtctcttttaactgctgttgctttaaagtttgctttgtctgatataaaaatcactacccctgctggcttttggtgtacatttgcatgaaatgcccttttctaacactttactttaagtttatgtgagtccttgtgtgttaggtgaatctcctgaaggcagcagatacttggttggtgagttcttatctattctgctgttctgtatcttttaagtggagcatttaggtcatttacattcagtgtcagtatgagatgtgtggtactgttgcattcatcgtgctatttgctgcctgtgtaccttgttttttttgtttttggttttggtttttatcttgtatttttgttttataggtcctatgtgatttatgctttaaagaggttctgttttgatgtttccaggatttgtttcaagatttagagctccttttagcagctcttgtagtgccagcttgctaggggccaattctctcagcatttgtttgtctgaaaacaactgtatctttccttcatatgtgatgcttagcttgctggatacaaaatttttggctaataattgttttgtttgaggaggctgaagataagggctcaatcttttctagctcgcagagtttctgctgagaaatctgctgctaatctgataggttttcctttataggttacccagtgcctttgcctctcagctcttagaattctttcttttgtcttaactctagataacctggtaacaatgtgcctaggtgattatttctttgcgatgaatttcccaggtgttctttgtgcttcttgtatttagatatctaggtctctagcaaggctggggaagttttcctcaattattccctcaaatatgttttcccaaacttttagatttctcttcttcctcaggaacaccgattattcttaggtttggtcatttaacataatcccagacttcttggaagctttgttcgtattttctttttttttctttgccttcattgaattgggttaattcaaagaccttgtcttcaagttctgcatttctttcttctacttgttcaattttattgctgagactttccagagcatttttcatttctatgagtttgtccaatgtttcctgaagttttgattgttttttctttatgctatctatttccttgaatatttctcctttcacttcttgtgtcgtttccttgtgtcagatttccttgcattgggtttcacctttctctagtgcctccctgattagcttaataactaacctcctgaattctttttcaggtaaatcagagactttttcttggtttagatccattgttagtggactagtgttactttggggggggggtgttgaagagccttgctttgtcatattaccagagttggttttctggttccttctcatttgggttccttctcatcctgtcagagggaaggtccattgctgaaggctgttgttcagattcttttgtcccacaggatgctcccttaatgtagtactctccctgatttcctatggatgtgattcctgttagctgagctgaagtgattgttatctctcttctgggtctagccacgcaacaagtctacctggctctgagctggtactggggattgtctgcacagagtcctgtgatgtgaaccacctatgggtctctcagccatggatactagcacagtatttggggtgtctcctgcgtcctccaggagccgtccacttccttcagagggtctgtgggtcctctcaggattcctggttcattcttgaagtctagatctattttttaataggctaatcctaaaaccatttactaagtaacattctttttttcattgttctgtaatgcttcctctgttgtaaattaagatcccgtaaatgctttagtctttgctagactttctttttctcctgttgttttaaaattttctctcccaacaagatatcatattgtgtaagtactatatgttcatagtaagcatttttatctggtactgaataatagtgagaatgcttcaaaatttcactttaagtatgctattaggtactgtatagctttttggctgacttatttttgtcaggttaagaaaactgctctctatttctagtttattatattagcctataaataatggtttttctgcacagtagaataatcatttgattcccacttttaaattattaatgcagtagattatattggtagatctgcctggtattaaactatccttacattcttgatctaaagcttatttgaatgggatgtgttactgtattctctctctcgctctctctctctctgtctctgtatctctcttcctcttttcatctctcctcgggaacatcttaaagcatattttggtaaatttgctttttatagttattgattttcagaaatatttctttgagaagttaaaaatgcaaaggttttatttcactttgtttcaaatatagtaattatctacaaacaagaatcgtccattttctacctattgagactcaaaacattcacagaacataaacctacttgtttcaaatatagtcgttatctaagaataaggattgtccattttctacatattgtgaatgaaaacattcaaagaacataaggccaaaatatctctttcttttggttctaacctgtgggaagcctgtcacttttctaaaagtcatgatcaggctgagcttcactccccnnnnnnnnnnnnnnnnnnnnnnnnncttgtttttgttgtctagaattaactttcatcttctgatccacatgaaatttgttccatgttgttttttacaagcaatatctagttgaattacccaccatgttttacttttttctcaccattagttcattcgtctaataaattcttattgcgtgccttgtgttggcctgctattatacatgcctggaaatataggagtcaacaaatgtgtctctgaactcatgtagttgacaatctaattagagaacaaagatgataaacaagtaaacaagtaaatatatatcaaaaataagtgccatggagaaaaaataagtagtataagggttgttatttatctaggttgtcaggcaagggcctgttacagatgtgtgacatttgaatgcatacttgaaggaagtctgggagaaaagtatcccaagtagagggaataccatatactaattgggatcttcaaggaacatcaaagcggccagttttgttggagcaggatgagcaagaagaacgtagcggtaaatggaggcagagatagtgggtgagagtggggttgagaaaaaaatcagataggactttcagacccctgtatatacttggtcatttactctaagtgagacaggatgccatgacagggccctgaaaagaaaaaggggacatgttcttattttagtgagaccaatttgagtgttgggaataaggagattcaaaagcaaaagcaggtaggccattaagaaactgttataataatccagataaatgttggtggcttgggtaagggagataaagatggagatgataagaagtgatcgcattctggatgtaatctgaagacatgtctgagaggattagttgacagagtgttagttatggggtatcagtgaaagaatagaggaaaggcctgagaatctgaaaagatgaaggtgatatgaaatggcctacagtcttgaatgagtagattaggaagtaaaattgaaagtctggttatgggttttataagtttgagatacctataaaacattcaaataaattattaaatagtgaactgggtatatgagcctgtaattcaagaaagaggtctggattaaagttattatttggacaacattgtcctacatatgccattagtgtcatgattccaaatgagataatctagggaataatcatagagaaaaaaggagaggaggataatttctggtgatatttcaatgctaagtggttgggaaaatgaagagaacacagtgaagttgaccaagatgaagtatttactgacatggaagaatcaatgcggaatgttgttcgagatacaaaattaagatagtgtgccaaagaagggggagtgatccgttgtggcaagtgttattcattggttaaataagatgattaagaatttgccgcaatgtggaagtcattggtgactaaagcaaaactattccattggtgtgggggagattaaagcctgatttgaataagtttaagaaattgagcaaagaggaattaaagacaggagaataagacaatttcttcaagaagttttgatttagaggggagcagagaaatgggtcagtaacttcatgggcagtaactgaaataggagaaaaggtcttttcctcttttttaaaaaggagagaattttagtgcacacttaaggtgattcttttcttcctgcaaaatttttcaaaattttattcatgtatatttctattccaatcgtttctggggtacaagtgatttttggttataaggttgaattgtatggtggtggtaaagtctgagattttagttcatccatcacccaggtagtgtacattgcacccaatatacactttttgttttgtccctcagcccccctaccccctcctcagtctccagtgtacattatgcctttgcatacccgtagcttagctcccacttataagcaagaacttcgtggtatttgattttccattcctgagttaattcttttagaataatggcctccagctccatccaagttgctgcaaaatacattatttccttccttttttatggctgagtagtattccatggtgtacatataccaccttttatttatccccttattgtttgatgggcacctaagttgtttctacatctttgcaattgtgaactgtgctgtgataaacatacatgagcaggtatctttttgatataatgacttattttcctttaagttgatacccagtagtgagactgctggattgaatggtagatctgcttttagttctttgagaaatttccatattgttttccatagaggttgtactaatttacatcactaccagcagtgtataagtaatcctttttcactacgtctataccaacatttattgtttgttttgggtttttgtttttgttttcatctttttataatgtccattctggctaggataaggtggcatatcattatggttttaatttgcatttccctcctttacgtattatttaatgagagtcttttggtggtaaagtatcttagttttcatgtgtgctcacatacacatacacagagtctttagtgacaggctagttgggtatcaaattctgaattgattttttttctctaatacttttaaagtttatttttgtcctggcatctgttgttactaaagaaaaatcttccactagtccatttgagttcattagtaggtaatctgcctcttattttaagtacttttaaagatttttctgtatcttgatgccatatgatagatctactttttattatactttacttagtaattactgtggacttttaatctgctaactcaattatttgattttataaaattatcagtaatgaccttttctataactgattctttacagttgaattaaatcctctctttctggaattcccatcatatgtgtgttggagcttctcaatctaccctccaaggctcgtaactgctcttttaaatttttcagtactactgtcttaattaaaaaaaaaaaaaaaaaaaaccaaacctaatattgcagtgtttggcacagaagaagttcaaagtacaactttgcagtgccacgttgaccagctatcctggcattggttattctttaaagttatttttaaggttaatataccttgtcaggcagcaggtctcaaaacctagggaagcttaaaagcctaaaggcagcctggaaaaaatcaagctaattaaaatgctctttcccattttctcttcctcctatgccctcatccctaaagaatagtgatgaagccttccttaaaaagatatgtataaaatagcagaaagaaaaaggggatccagcaaacatgcgaagacatacttagataattcacagtaaatgttccaaataatattcagcctcactaattctcaaataaatgtaaaacaatggcagatcatttttatccattaaattagtggcaataggaggaaaagaacattttgctgacaattgtaacagtgaaattgaaattctcttcttgtctggtttgaatctaaattaggacagtttgaaagcaattgggtcatatctatgaaaaatctcataaacattctacccttccatgtagcaacattgcttctgtgaatcaaccattaggcaataaatggaaataacaaaccaaatttccccccacctcccaagagatgtttattgtaacattactgataatattgaaaaattagaagcagtctatatcagcgacccacccttgttttgactgtcacttaccataagaaaatattaggtctacaacgtaacccaacagccacacccatgagtcaaaaacttccatataaggaaactgttcaatccattctatttatttaaacacgccaataaacaaagctggttttgatccactaaactgatcctaaaacctaggagtaggttatgactcacagtttgaaaagcaccaatctgaatgtcctatgaaaggcatatgatggaatatgaattaaatttgatattcacaattttttattttgtttttgtttgggggtagttggaggggtactatgtttcctcagccagcaaggaagataatgtttccagataactccatataatggggatttactgtaatgataccagctctgttctactatgcccagtcattctcgtgtatctatctctcaatacaccacgggtcctttatggattcttttgtgatgtcttcaagctccctgtccactctcttgcaacttgtccaagctgatagaacctgcctgaatcactcaacatctgatttcaagcattttattttggtcagcctttggtattaggacttcattctcaatctaatcaattaatattagctgagctaggttgatttcatttgaatcaacaaagaattgctaaaagctgcatttcctagaaaatgtggcaatataattggcaggtacttgagagtctctaatgttaaatggaaaaaaaaaatgaaaaataatgaaagagacaactttttatatggagtctgttttcagttttatttggatattttgttagagacaaaaaaggaatcctaatatagtataaaataaatttctacataagcaagtattatgcatttgtaatcagaaaaaatatcaaaattagctctgtggaaaatgatcatcttgcaagcaagtatcatgtacccttcctcttgatttagctcatcttcttgatgtaaatatgaagtgtctgtgactgaaattctgtttgaagcagaaactttcatgtttgtcttacaaataccatctcagagtacgttgctcagtataaaacttattttgggggttgggtacaaaaacctgcaaggatatagtccaggcttcttttcccaaggtccttcactttcctactcttagtgtaaccattattttgtaaaatttgataagacccttaataacttggggtttgggaatttgatttgaagtaacatggctcagagtatcacctattttttattaaaccaaaaaaaaatttctatctgacaaagatgtgcatttatgtgggccttaataattcccccaaataaaactattcataagttctaacagttccaaatacttctggtttcagcacactaataggatttataactgtcttagataaggagcagtatcttctaaagctcatggaaaagccatatcagaatgccatgtgttcaggtacattatcttttctttatgatatcaagaataaaatctcggcttatgtttttacacaagtcttgtgtgattactctttcccattacttgttcaattgagcctgacaaatgaggtgaaaaaatctttctctttcaaggatgaactagaaagacctaggctggctggtcacaaaaccactgactagttggccctttgtctttttataacccctcattgtctgggatccaacatcgtaatgagtctcagacatgttcctcaagtctagatagacctcatccatgtgttcggtgatccagcccgtcagcatccaagccagcagtgtgagaaggggaagtgtaggggatgctcattgccctgaaggatgcatatgccacttccagtcaggtcctgctcgccagaacatagtcatgtgaccacagttagacacaaggttggctgagaaatgcctttcgctaggttctatttctaactgaaaataggaggagtgaaagttgggataactagtaaatatcagttagtccaagtcatggattgtggtattaattccataagcaaggaaagtcatttaaatgttttatgcagagggataccatgatgataattatgtttcaaagcgtgtttctgtgtgtgagagagagagactgaaagagagagtgagataaatggattagagagaatttgtctgggtattaagaggccattctcaaatccaagtgagaaatggtggctagtaacagtagtgaggataaagagggatggaatggactcaaaagatacagaagagataacatcaaaagatgaaacgggtagaggaggaagaaaagacatccaactaactcctaagtttctgatttatactgcaaattctggagatcaggtgtttatggaccactgagtttagttttagaaatgtgctttagaggtatttgtcagataggtggtttctacacattcaaaataagatttcaaaacatattagccacaaattcacaatcagcaaaattctcaaatttggtcattgtcaactaaactattaaaatgaattttcccctctgagtgtttctcatcttaaagggtttgtatgtattacatgtcacagaacggtttattgcatataaacatgggaaagcaagccaggcagaagaagtcttgtaaccagctaaaggcccagctaataaatcatgaacagtcttcttgtattaatagtgtggacaggactgttggtcacacacaggaaaatgagtcacacagtcttgtgtgtacagcaactcactccacactcagtgatgggaatgattgttctaaccgtgtgagtggctacaataattatggcaaagctccagagctagaaagctggtcttttttttttttcagtgtcactcgagtatgtaattcactaaatgtttagtattttataccttttagttgacttgtgagcgctttctaaaagaggtatatttccctctattagaaggtaatcaaaaaaaccctaaactgcattttctaaatgctgtgttcttctgcccaattgaccaaaatatactcagttgattaggactttgaagggttggggtgaggggactaaattaagatgcaggaatttcagttttctaggggttttctagtcaactactttatactgctgacaaatggttaaatgtttacaatgaaactaagtatgctaggatttctaatgagcaatgaaattttagaattcatttactcattaattttttcatttacaagatgtacaatgtgctgtcttctgggcatttgggatactttaatgaggtagcagtgagtacaacggatggtcacttctgcctttgttcttctactctttagagaagggaaaggaccaagattcagataccctatcactgctttcaacccatccacatcagagcctttgttgagttctaatgcttagccctcttctcagctaatttggctgcctccattgtaataggcctcatgagactccagcccaggcctggcctttggttcagcaggcagagcccagagatgtactgggcaaaggtcaggggatttattatatgaggcaatggtcgggtgtgatttaatttactcctctggtaccagatatgtgtgtgtgtgcatgagagagagagattgaggatgattgattttggaggaatttttgtgaaggtttatatatcaaagcagaaagaccaagaagttagagattaatacatgccaagtcgtgaccaagaaacttctgtgggatcccacctccaacccctccctctctgccagattttaaccaaatcagtgtgatgtgatctgcttgcatatatgagtgaaagaaaaaggaaatttaaaaagttcttgatataaagcctggaggaaacaatacgaaaatccagcctctatttcagcaatatctgccggactattggttagtattcccttactgttatttattgtttgattaaaaggctgatagtcagggttttgttttggttttttttttctacttactttcgcattttttagatataaatctttaacgtggctttgaccagatgttttcctttctcctcccacttcattcttccctcttctgggttaatttctctcattgttctctcttccctttacttctctgcccttttcctttctactctaagcgaaacttctattttcgtgtgctggagtttataaagtattcttattaggcaaagaaagcctttggctgccctcctccttgtctggtcaccatcaagatataattttggttttcaaaggttgttctctgaaggaaggactagttttctgagcattgagacagcagatacattttgagaaagtcaacagggatggtaatttgcattaagtaggaaatacttaagggttttaattctgttccatgtgttacatttcaacagtttacattaagaaaagtattgtaggccgggcgcggtggctcaagcctgtaatcccagcactttgggaggccgagacgggtggatcacgaggtcaggagatcgagaccatcctggtgaacacagtgaaaccccgtctctactaaaactacaaaaaaactagccgggcgaggtggcgggcgcctgtagtcccagctactcgggaggctgaggcaggagaatggcgtgaacccgggaggcggagcttgcagtgagctgagatccggccactgcactccagcctgggcgacagagcgagactccgtctcaaaaaaaaaaaaaaaaagaaaagaaaagtattgtaaagaaaagtgatacaacagttgcatgtttattttgtatgtttagtctgagagatggtcagtactttgaaggaaagagaaataaggctttgtctcctgcttcttcttatacctctttgcagattaactctgatgctttgagtgtcttactgcattgcctgattaaaacccatcccataatgcctgatgtgatgggaaacaccacttactctatctcaatggaaagcattcagatgaactttcaacagaaggacatgctcccgcctcttccaaacacctcttttaaaaccgtgtctatgggcctttcttcatgtcttcaacaatttgtttaaaactggttgtgctaggtagtgggcaatataaagatgatcacaggaaagagatgacaatatcactgattccttatagtgctataataagggtttgtcaaggttgtgatagaagtagagaggagaggcacctgacttcacttgggtgtggggtttttgctaaggtgcttctaagttgaagtgtccttgagctgaggtttaggggaatgagtagcaaagatggattaaatgagaagaggataggcggcagcagggccagaggtgtgaatagcctggaaccttctgagaagattcctttgtagacagaagaaaggggagatttgtggaaatgctggaagataaggtaggaagaggccacatcagatcacacatggctggctgtacctctctaaaagtttatgatttgtactggggggtttgaaacagaggctataaattggcagtttaagaaaatcactgtggtgttagtgggaagaatagattttggcaagattctaactaggattattttcaaaaatttacgcccagtttagtccagatgtcagggctagtttggagtaaatttctttctttaattactccagggctcttgtattgcttcagagaaagtagaaaggggaactcaccctcattcagggagggtaggcgagcgaccagccagctggggaaggccaaagagccaggtcaccttgtgcccacacttgttatgatttgtttgtactgtctgctggatgatcaatgatattagctacgacagcacatatgagcccggggtaagtgtgtcttcttgctacttgaagtgcttcttgaaaatagtgacaggctgaagacaacacggaatactgaaaaagcccattggacaggggacaggagacctggtgctgctcccagcttggccagcaccagccccgggggcttagacacattacttcacctctctgggcttaacttacccatttataacatgcaacctttagactaacactgtcctcggggccttgttcagcccctggcttctgtcattgtgattctgcgccccccagggtccccctgggccccatcactactaaccctaggcttctagacatgttgattcatagagaaataggaaagccatttatcttcagtgagtgtaagccagaagtacagttgtgtcttaaggaatctaatctagtgaacatggaaaatacttttctaaggaaaaaaattgtgattggtgttctgtcctgagctgatggcaaaagggaagcaggaaccacttcatacatctcaatccctctgttttttcctttctatcctcttgaatttttcggcctgttcgtctttcaaaagtggagaggagtttgaatggggatgctgaggacactgagggtagccacctatggaagaggcttgactgggaagccgagttctgccacctgacaaaggggcacgtgttcagtgtttatttggcatagcagctgttcaggtggagcccaggcagaattttgacgtcgttgggaccttccatacctttctgaaaatctcttgcaccaacacccggcaccctcaggttatgttctgcttcccaaagttcatccccaggctcaacttctaaccctcttgttttctcttttaccagaactaacttctaaagatccagagacaacaactagatggtggtctggatgttcctgaggtggaaagagaacctctagtgcctctggctgacattgtatccactgacaggtcccctcccacatgcatacatgtaacatgtttctgctcacttatcaaatacagcccatgctttgatgattgaggacagagtggggattataagttgatgcagtaggtctgtgtcttgccctgagaacttcacaaacagcaacacaggcaccaagaactcatcactcatctgttccacccacaggggtttatcatcttgtgacttggatattgtggaatattttatagtaaaggttaaaaaaaatcagtgtaggcacagaggagttaacagctacgttgcagtggggagtatggaaggcttcatggaggtggtgatatttgaacgtgactttgaagggtaggtagagtcctgacttctctgacagtagccttgaaagtaggggaaacttgaccatgaagaaggctgttgaaagtctggagaacagaaaaggtaggggactaagactctaggagaaggtactacattccagagagaatacagaagtataatcctccctcatggtgacaagttaaatgtgagaagggatggactaaccaactgggtgaaccctgatctcattaagcaagataagaaatagaagaaatgaatctgcatgttcattatgtagggatcagaagcaggtaggaaatgccgactttattttagacagaggttattttaggtacctgtgggcatccaggtgtattatttccctatgtctgaagcacatgtcctttggttctttagcattttgatgatgatgctacatgtaaacttccccctagggattttctgtaagttttcttcctcattcgagagtaaagttttaactggtaacatgatcacaagtggttgaaaagttaaaatgctagtcatataacttttcaatgaagggagcatgaatggtttggtactgttttacaagatgtgaaaactgatttcacttaagtagactgtaacataaagtgcttatgtgtctgtccctttgactttctggtaggtgtacagtctctctgaatcaatagtggctcagacttctgatttcaaacctcttcgggcatccaactggtttgggagaaacatagccaggtcattgaattataatttcctgagttatggtgtggtggtcccataggacagtaaacataagcctcctgggaactgaacttttaattcaggaggactgaaaacaagctcttctgagtcaagatttgcaaggacatgtgacaaagatagactggccttcccgcttccacaccatcttttcctccataaatacgtgctccttatttttcttctaccctagtctgttgtagattttgaccttggctgttactttcctaccaacacattgcctgtttttaagtttcctggtttgacctgatgttaagatggaaagcaaggctagcaaactgatggagatagagccttccagcctttctcactttccctgggatcatctcatgttgatttacatgttcaaaaaaattttttaaagaaataaattgtatcagttgctccagaggtgattagactctaggggcctgatttctcttagccaaacttaagacatgggccaatacaccaaaatgtcaatatatttatttgtttcgtattgcactgtcaagcaatttcatttcatctgattattgtgttcattttcctgaaagatagtgatcccagaaaacaagaatcagaaggtcatttgacaactgtggagttgaaatagagggaactaaatgaccttagggcatagcatcatcaagctttgagaaattattgtacctgtctctgtgttgggacattctttttggtcccaggtagttggaggagacaaagctgtaaattatttactagtttttcaacatttccttatcgtttattgttaactgacggaactatattgtctctgaagtcccttatgaataaaattgctagacattgcaaaaatgtccctctcaatattgacatgtttcagtggtgattattatcttcctgattaatgtttacggtcaatctcaagctctataatggactcttaaaggctgtagcagttttctattgcttccataacatattaccacaaactttgtggcttaaacaatacccatttattgtctcacagttctatatgtgagaagtctgggcacaccatggccaaactgggctcttgcttagaatttgcaaggcagaaatcagtgttgttaggacctctagggatgaatttgcttccaagccgattccagttgttttcatgaactgagttccttgccattgttgaactatattcccccatttctttgctggctgtcagctaggagccggtttttgctccttttactcctgtctgcattgcatctcatggtttctgtgtgcccccttccagcaacaagattctatgtaccctcttccagcaacagaagatcaagtccttttcaagtttctaatctctctgacttccccttctgccatatctcattctgcttttacaggctcgggtgattacatcagtttatgcaggtaatccaagataatctccctattttaaagccagtgggttagccatcttaattacatccacaaagttccttcacagcagtacctagattagtgtttgaataacctgggatggtaatcttgcaagggatcttttggcattctgtctatccagtctcatcagcaacactttgaaatattgtcgttacttgagtgatcatttctgtgactggctgatttcatctatacatgtatattatttttatttgccattttgtagggtaatattttctgatcttaattccatatttcagtattaaaattacttgacatagatccataaatcatcatctgttgcaataaagcacattaattggttggtagaatggggagactgatatttcttttctcttcttcttggatgagggcaacttttgggggcagatgagttctgttgtgacaaaagttatatagcacatttggtttgcactgaatcagcgattctcaatcctggccatgctttagaattatacaagaaaaatcttcaagtatcaatactcagtccctaccctactgatccaatttatctatgataaagccagagcattgatttttaagttccccaggtgattctaatatataaccaaggctcagaactactgatatgttccaacattctgttttggagataaagaagttgaggctgaggatgagaacttagtcacataaagtccataactagtgacagacataagttctgtcctacaaaaaaaaattgatggtttaattgtatgtagagttcagtgctcagtaattatgtacaaagtgagtggttgagaagatctggaacaccctacttcttgctttagtaggaagactatttctttctatgactttaaaaaattatcagaccttgcaaaacaacttatgaaggtctcttctcagcagctttggcctgccttgtgagtaataataaacacagatccattttacactagctaggaagctggccgcgtggacttctcctactcctctgtgttccagagcttcatggtacaatgcagtagccactagccacatgtagctattgaacacttgaaatgggactagtttcgattgagatgtttgtgagtgtcaaatgcatactagaatcaaagattcagtatgagaaaaacggtgcaaaatatctcattaatactttttacattgattacatgatgaaataatatttgaatatattgagttaaataagatacattattaaaattaatttatcaattttttaacttttttaatgtagttactagaaaatttacaactatgtatgtggctggcatttgtggctcacattatatttctgttagacagcacttttctagggagtattttctattaaagctattgacaatgaatggtccaagtccaagctattatacctcctttgatcttgaagagtgaaggggtacattataatcttcctggagatgagacatgatattgatctgccctgtgtttgccatctatctggcagccagtcagtctggccaaatagacttctatttttacatagaagcttaaaggaggcaggataatgccccatgtcatggagagagcatactgcatagctcttaagtaatgtacccaaaagtagaccaggtgctattggaggttctaaggcatagcaataaatattacatcccttgagcaatgtaatacagcccttgaagaaactgccatgtctttgacaggccctatgcactgaaaatattatgatgtctacctctctttataattcacatctaaatattactctttttcttgctccctgtagtttgttctgattcactgctaccctgattgtgtgtttagcgtgcctacttcacaatttaagagtcatgggaaagtaaaggcaggccttggagagatcaagcacagttcaaaaccctacccagagatattctgcctgtgtgagcttgggaggagatttacttaacctctctgagctcctctaaacttccattttctcatttgtgaaatgagcatttctcttgcaaggtctgtgtgaagattgtatgaaataagaaggttcctggcacacttatttgttgggtagatattgtggtgaacatctactctgtggcaagcccatggctaattgttagaatgtaatcgtgagtgagacacagctactgcctccagctaaaagaagagaaagacaaggaacctagtaacatcaggacatgaatagtcatcaatgaatggcagttattattacacagcacagtgcaggatttggcttataacaaaaatttggaagggtgttcaggtgagggaattgagacccatagtgattaaatgactacctgtgtcaccagctcaggcaatgttgggctggtgccaggttacgggattgctgactcctcctccagtaatgctttccccaggagatcacattgcctcactcttggtttcccaacttgtttgctttaaaagaataaccttgccatgttggacttgataaaaggaaagaggggtttctcccaatttttgctccatatgttattcgggcatgctagtaactgtctttgaaaacctacacttctgttatgttaactccaaagaaggcagcaacacgtgcacttctttaagatataaaaagcatttagtatactataaattattatagtaatcattgttagattatatctcaccaagataatgaatgttttcatttgaagacttcactgtatgagaacttgtctcctatagcttatttatctccttttagattaggtgaaacagaattttcaaatttgagtctgaagaaaattccaacatctttaaattcgtttaaggagcattccccatggtctatatgatctatcatagtaattaaaaaatcagattttagaatgagccacttgtagaaagagaaaaaaagtagaaaatcaataagaggtttcatttttcaaattctgctttggaaaaaattacttggtagggacaatagtgtaaagtaagatataagaagaaatatatcattcaaataagcggccatgcagttggttatctctttcatgtaacagtcacatctgcattgtgaattcattaatgcaccaagtgaatcaagcttagtgagttgacaaacatccacagggatagttgcggggaggcattgcaaagtgcaatgtgaggtcctagtgaaacagaatgcttcgttctttgagaaagttccactctgaatagaaaaactatgcataccaagatcggagtatggccaagcatttggctactgaaatgccccttcttctttcattcctccataaaggaagagacagagactcaggttcttgtaactcagctgccttttttgagttctcccaagagacgttctaacttcaagccaagcatcttgtcactgggatttctgtatctaatttttagttctagaaatccatgatttcacaaaacaaattatctgaacctaacaacaaccacatagaattttcttaaagtagacgagggaggaattagcccctaaagtatttcctacacaattggaactccctttagaagatgtgcaattgcctgtacacccaagcacaaatgggctgtattattgccttatctaggatatacacactttacattataatggtccttccctttccctgaacccgcatatgatgtaagtgcttgatttaggaatagttacatattgtgactggcgaaaagcacatttgctgattgctctgccacctgcctagatgtatatttatatatcatgaagatatataatttatcttttatgataaattataataaaagataaagatatgtaatatatcttgatatataaatgagggtccctactctcagtataccccgtaggaacattataaaacataaatagtctgttgttactactaccaagaagactttagtaagtgtaataactaacccttttggatacatgcagagcgaatgccaaatgctttaaataaattatcgcatctaatcctgatttttttatgaaaaagggaaaatcttatcatatcaatattagagatgagtaagctgaggtttgatagagctaggattttaacttagctctctgtgactccaaagcacattcacttaaccccaacctcaccctctctgtaaatgaagattaacaatagcatctgtggtagaagctaatgtctcctgatctgggaaagtatctttcaatgattattaactaaatgtgatcagctgccactggatcagatgtcatcaaatgaaattaagtgtccagggtttactcaacagtactgtctcttacgttttgtatcaatgttagtagattgcttaatttttgtacctgttacctcacatgaagcctagatagcatcagtcccttccccagccagtgtgtactgggtccagcttctggcttgtgaatccaatcagtgaattaatgttggtagcttaaaatcagccttgaaagaggtatttacaccacagaaattggcaaatgatacaaatcatgaccctttttttaaattccagagagacaagtgttaaacatttaccagtacaccactgtctgtgactcaaatagggacataatgtgaataattatacttctgaaggtaaatgaatgcacactgggtacccttgaaaaaaacaaccttccacagatacaatcatacctaagtcacctaagtctttagtgaatatttttgtccccatcattctgcttttgggaggaccttttacaacataatcatgatgattttacatgtcttttgaatttttaaaaaattactttatttgttcatttttgttacaaaagcaaatatgcccacagtaatcatttaatgtttttgaatgcaagtgcatacatataaacaataaaatgtatatatgaatgctgccagtagaaataaaatgcaagtcacgtatgtcatttaaaattttcaactacagtcatgcaccacataatgacttttcagtcaatgatggactggccccataaaattataatatcatgtttctatgatatcttttctatgtttagatatgtctagatacataaatacttaatattgtgttaaaattgcttatggtattcagtagagtagtaacctgctgcacaggtctgtagcccagagcaataggctatcccatatagcctaggtgtgtagtaggttataccatctaggtttgtgtaaatacactctgtggtgttcgcagaaccatggaattgcctaatgatgcatttttcagaatgtattcctgtcattaagtgatacatggctgtaatcacatttaaaaaaataagaagaaacagaggattttgttttaataatagatttcatttaactcagcagtcaaaaatatgatttcaacatgttgtcaacataaacattatgaagatgttttgcatcttttcttcttgtactaagctttcaatttcatgtatattttatacttatagcacatatgaatttggacgctaaattttaatcataaatacttgatctgcatttacatttcataaaatgtaaagcttaaaaagtgggttcatatatccaacatgttccaaatagacttacatatttaattaaatttaaattgtcattaaattcctcaattgtgttcgccacattttaagtgctcaatagacacctgtgacttattgtaacagaattggtcagtgcaggtatgtaccatatatccttattttataaaattggagacctaggttggatgtggtggcttatggctataatcccagcactttgggaggccaagacggaaggatcaagtgaggccaggagttagagaccagcctgggcaacatagcaagacgctgttaataaaaaaaaaatagctaggtgggttggcacatgcctgtggtacaagctatttgggaggctgatgaagacggatcccttgagcccaagagttggagactgcagtgagctatgattatgctactgcactcccaacctgggtggcagagtgagacccatgtctcttcaaaaagtaaaaatacaaataatataacaaataaataaataaaattggagacctactatatgtactactcccaaaagtctttttccccctcacaccttacacatttaaaattcccatcctgcattccccactggatctccaagaggagagaaatctcagcaaaagtagttctatcaaaactgtctgtgagctttcctcattcataggaaggaaataaattcacctaaggcattttagatctgaccattttccaaattatcatcaccataaaaagttggtaacaacatgaattctgaaagcaaactatttcaatgcatgcttggtgctaatgaaaaccagcagttttaaatgcccttttgggttaacctcttccttttcctgtgctgtattattggaaaagcttcagcaaggagatcgactagattcaatttcacaatatttcttagtaatcaatgctggcatttactcttcccatctattaatatattaacatcacacttctaaggatgcgtctaaggatgctttaatcacttttaaaaaaatacttgatacaaattagagggtgtccgttattttaggtggtggtttgttttatttccacaaaattacaaaccagatataagcatatttttccctgtgtggcttaataaactttttttttttttgagacagagtctcactctgtcgccaggctggagtgcagtggcgcgatctcggctccctgcaacctccacctccatggttcaagcgattctcctgtctcagtctcccgagtagctgggactacaggtgcacgccaccacacccagctaatttttgtatttttagtagagacgaggtttcaccatgttggccaggagggtctcaatctcttgacctcgtgatccacccgcctcagcctcccaaagtgctgggattacaggcatgaatcaccatgcctggcaaataaacttttaatataattgttgatgaaggtgttatggagacttgtcaccataatagtctagtcttctccttaaattcacgtgatactcctcatctctatgtagctctccctcaccttcagtaatgacctcccttgtctctcaatctttggtctcttaccttcaacttcccactagtcgtttctcacatttccaaaagtcttataattgccttaaaacaccaagtatctgaagcagtcctatgaccttctcctcccgctaaccaactcagatccccaaatcctgatttctttcactagcactatctctcatccacacatacccagttatttgtgacagacgtgtctctaccatctctcatatccaatcatcaccaaatcttgtcaatacttctcagtgatattaagttaagaaggcatgaagggcagctgtaacctaaggaaaacccacttttgcaccaaatctctagtgactttctgatcaatctgagttgaaaatgctgtttttttttgttttttttgtttttttttttttttttgagacagagtctcgctctgtcgcccaggctggagtgcagtggcgtgatcttggctcactgcaagctccgcctcccgggttcacgccattctcctgcctcagcctcccgagtagctgggactacaggcgcccgccacctcgcccggctagttttttgtatcttttagtagagacggggtttcactgtgtcagccaggatggtctcgatctcctgacctcgtgatccgcccgtctcggcctcccaaagtgctgggattacaggcttgagccaccgcgcccggcctgaaaatgctgttttaatctggtcctacctcaccaatctaattttatgcccttttattcgtaaatttgaaccttgttctctattcactagcttcctcagaatatcgtccaaaacatactcagaattcatactcacatccagaacatttgctctgagcttttaccatacaagttgaccatagtttctctcccttttccactcttatctgtcatctagttctaattttaagactgtcaattcgatacctgatttttccctagtctgaccttctattttcagatatgccccttcttttcacagtttcatgtgtttgtactgccttattcttgaagaaccatgattttgattgcttttgcgttaatctccgtagtgccttgctcagtgctagcaggaactagtagtttaacaaatacttgctaattataaattaaagagaattaaacatattggtttctttgtcaggagttggttatagcatgctggaaaatgtattatatctaaccctcatcttttctcatgtgtttacaaattgttttatggccaaagaataagttagtatatcatgggcctaattatgtgattcggaggcctcctctgctgggcagtctacagatttaaaattcatgccagctgcattacactggttttgaacttgctttttcttgagaaagatgggaagcaggcaaaatgcctcaggctttcagggtggaaatggtgtgagttccattatgcaagaatagaagcccattttttatcccgcctgctgaaaatcttgccatgagtctatagtcaaagaatgtgtaagtatcaaaagaaatttagagagggattttccctaggaaaatattgcaagcttaaaaaacccagggagctaaggtccaatttagtagattcctctgaacaatgccatcctctacttagattattatagaacctcttatgacggcatttgagtggactgctgtgtctctgggttaataggtacaagtaataagtttaggtacctgggcaaaaagggtttggtggaggggaatagagggactttctttttctcacatctggcatatcattacattgtaatgttagataacattaaagttccgaacttcatgtgtcagcactctgacctttcctagggacattttatctcggctagaacctaataaagattccctcatctagaaggtgccatgtggggctctgcaaacatggcgtggactgcttacaatacagttgaatgtcacttctcatggcctggctcatgtgaggaccctagagagagttctgcagaggagtgcagagggctacttttggagtcattcccactgagccaacatcagtggaagagaaggggaagagttaggttctaatcaagcacttagcttctgctgaatccatccacatttctttatcctcctcctggcccctggtcttagttagagttgggtccctatgcggtgttccaggaagcagtaaactgcactcacctcctatttgggagcatggcaattttaaatattattttctcctgtaggagtatgcaaacagatttctggttaattttgtgttaaggattcttgtttgttttttgttttgatagagcacattctatggacatatgttcagcttgtaaaggaagtgttataattatagttcctttttttttttttttttttggagactgagtcttgctctgtcgccaggctggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaaagtttcgggattggaggaaggtcatcaactattcaactgaagtaaatgccatttatttgtggcatctgccaggtatccttgagatgtctgaagaggtgacttccaaaccagaggatgtggccttctgagaaatgcaaacctgttcacaccctcgctcagatgggaagcaaaaaaggctgcctgggaattggggatttactgttataccctgacatcagaatagcaggtgctactggaaacttctttacctgatactaagtgtcttgggagataacaagtaaaattaacactgtatacagcatccagttcctcagtgttttcttcacttaaaaagaatcagctgggcacggtggctcatacctgtaatcgcagcactttgggaggccaaggcgggtggatcatttgaggtcaggagttagagacaagcctggccaacatggtgaaatcctatctctactaaaaatacaaaaattagctgggcatggtagcacacacctatagtcccagcaacttggaagactgaggcaggagaaccacttaaacctgggaggcagaagttgcagtgagccgagatcatgccactgcactccaggctgggcgacagagtgaaacaaaaaaagaaaaaagaaagaaagaatcaaattcaaagcaaatacttagttaccaacaggattgcatttttagcctataacatctttttttagccttttaatatgtttctgctggaggtttccagctttgattacatagcctgttcacctaggagtaaaggacatggggagggagagatgttcagtggttctcatttggaaagtagataaggatgatgcaaggccatcagctcaaggccttccaggttaggaattaaaaacatggatgttgtaaaaaccacaactcatatttatttgaaatctcaccattgacaaagtgtgttcacctgcatgtttacactcagtcctataaacgactccatgaagcagtgtatggaggagagttcctcatgcatgtgggtttgcacatggggattcagatgcaagaagatacttagtttacatagagatatgttttttattttatgaatataaaattatatggaacaaaaaaagataagtcctctgctgtctagaaattacagtacatcaagaattttatccctatgtagaattacacagccattgccagaggaccacatctgtaggaccatgaaaacaaacatctttgctcattatttcagcctgattagggataccatgaagggctattccattaggtcaggtttgcacagtaataaaaatgatgccagtagaggtcctggtggagctcctagtatgatgataagtgtctgagtaacttgtaaatagtgcaattttatggaaatgttgcagctaagctttaaagtagttggcattagttgttagacacaacaacagctctacaaaaggcaatatgctgagttcatttttgactagcccaaacttgcctcaaaagatccgggatgtggacaccctggtatattttttctagaaaagcttatttccttcctccagataaaggtgtatggtcactgaggtgtgtactgacagatgtgttgatctactctctccgttaaactgaagggctccaggtgtggccacactgggcttctaaatgcctagcaaagccacagatgcatccctcttggtgtctgaggtgttcacattcctgggtctttcagatctgtattcctcatgaaaataaaaactctctacgatacaatctgtccttgtgggtttttagttttactagggagtttttgttttcttttgcttcccgccttctttctgcttcccttctagttaaacctctttaggatggctcattagcactttgttttgagtgtgttgagctgttttgttcactgggaaacagatttatgaaatgttactattaccgtgattgttctgtttttccttttatggcctgtccagctcaaggccccatgcttgctgatactgctgataaggttttctatttccagatcaaattgaagcaaaccttactggccctgttactgaagctgtgcatgggggtcatttgctgtgaggtgtttctatggctttgagccaggatgtgaacatctctagtgttcatgttgtttcctgagacgagtactcacgggcagtagaatttattacaacctgctgtttgagttcatgaaaagtaggacaatatgagactcggggcaatgaaagacttactaggattccttctggaactgattcatcagcacattcatgtcttacccagtctttaaacagtatttcatgataatggtctgcttttatttgctgggctttaccttactctttttgtgattgcaggtcctacaggtatggatctctggcagctgctgttgaccttggcactggcaggatcaagtgatgctttttctggaagtgagcgtgagttctgcttttccatttccaccctcagtggtttgaaacaacactgaattgtatttgttatatccaagttttgtggatgattttattaaaagatgcaagttttacatagcagcaaataggaaacttgacttaactttaaaatcagaaactagtaggacttttccgtggatgtttaggaggaacgcagtagtcagtcaactttggcatctggtgttttcatgtcaaaaattaatgctacaaatcatgctgaggacatttatgttgaagaaaagccaggtctcttgttctcaggctctgggagaaatattgaagttacactgaagagttattagcttactgttcactcagttcatttgtgactaaggatatctagtctatttccagagctcagaattcaggcttgttaatcatattctctgagaaaggaaattgcaggtttcaaatgaatttcacctctcactctctgggtgattaccatttggctaagttgagggaagagacacctgaaatagttgaatgatatacccagaaattatgagcttccttccccatctctataattctccctcccttttttatatccctctcctggtagagaagtctcaatatgtataaactatgtttcatagcagacctaactaaaacaaggaagagtaatggaagggaaagtggagaagaatttttctgtcagaaagaaaactgtgctctctaaagggtggtgggagacctttttttttttttttttttttttttttttttttttttaatgagtacttgatacttttccttgcctgtgcttctacagaagaaagaaacaatgtatttctcccatgctatgacactgaatttagttgttactttaggagtgtctgactccccttctcaccattcagctcatgttggaaaatacagtttaacagcagacttagcgccttaagatgtcctccctgaccttctagccaaaaataaatccgtagtagtgagctgctgagggtgaccagagtcacttagaaaacgagaagagtaaaagatgttattttatctcttaaagcaatttaaaaatatttatagaaaagagtcataattgtttgaaatattttttggtctctctggtgttataatgtcaacattatgcaagtcaaacatggagagaattgcaggctccgtttcagcagcttttcccatggctggttttagaccctggttctgagccaaaaaattgcagctgagatcctctgctgttccaaagtcatggtggcttaatctctcgtttcttcattaaggtgactttcactctactgggcaagatttgaggaatttaaaaaacttgtgaaatgaaaagtatggcataggaaatctttaaagaaaatttaaaatgcatccccagctgagagattagagctcaaattacattttagagctagaaagtctgcacggagcatctgtttccactgcttcgacattttactaaacctttgagttcctgagtgaagagaaaacatcattagttgcttttaatgcttgatttttttctttttaatagttttgtttgattcatttatttgtttagggagagcagaatataagcaaatgcagtggtttatactaaacacaaatcacatatcctaccagtggttacacataggaagtaatttaacaaagaagaacatttttgtctcctttttttttttttttttttttgtcttgttgagctaaccaatatttctttttcctttggaatatgtgcatattccagaatcctttcttaaaatgatctaaagattaaggatggggtatgatgtttatgtaagaaggcatatgtaagctcattccagcatgtgtgtgcatgcttgcctctgtgtgtgtgtgtgtattctagttctggccacttatctaaggggttcttgggttcagccaaagttactgcataacatgacacgggtcagtctcagatgacatttatgggccatgtgtttgtttttctgccaggtctggattgtagccaaatcnnnnnnnnnnnnnnnnnnnngtagacgatgacagacctctatgcatagggaagggtggcacttgagcagggattttcttgtgggcagatgagcaattagaaatatactggccctgaaaggatttttttaaattaaatctaattgccctgtgggaaatttaatgagaactaaatttgaatagtgccattattgtgctagctaaagtgttgtaatagatattttctgtctctcatccttaacatgaagctctcatccttaatatgaagctctatgtctgctcctcaagccaattacatagtcttgaggagaattttttattccaaaatcaggaatgatccacaatgccttgttttcaaagggcttcacatggttgacctgtcaactgattgtatcaaaattgctgctgctggaatgatgttgctagtgagaaatgtgcataaagatctgatggataaaagtattcttccaaggagtgcctgttataaattaggtcgtatatctctactatttcagtcagtcctcccctgaatataccctttgacctcagtaacctaaggtggaagtaggcaagcccctgtcttgtagttcagtctagctaggacatgaggaatgtcttgaaattaatgagagactgtatatctttaaggtttagattgtgtgatgaagagaaatggtcaagatgccctgaaaaagaatagatcaaggtggactagaatagttaattcaacaaattcaatgtactgataattcttaagagtttcctattttcaaagcctgcacctacggctatgaggaatacattgattcttccctcaaggaacttttcatgtgttaatagatcaggcatgtacaccaagaattacaatatcaggcattgtatattaactatcaaaatggcttgaatcacactttatagaagtgatgatgttgggagggatacctcagctgtggtgaattacagcttcatgaaggaggctggcattgtttcaatagagactagaatgtcgggtttaagattttaaaaggctgagaagaacagaaggctattacaggaataacttatgcaataaagcaacaacataaacagaagtgtacaaatgtagatatgagatgtccatggagaacacttcattcacttactgagtgttttttatatatatatacatacacacacacacatatatatatatggcactgtctagtcgatggatggttctgttttagcatttaacattcaacgaatatttcttgagcacttacttcatggaaggcataggattaatttggccagggtgtgtggtacataggtgctatatttgtaattattccccttggaagcaaacttaggtcagtaggtttgagtcaaattatagaaggcctagagatagcaaaggcattatggaaaaggcaagacttgctgggcccttgaagaatcagtagcatttggagaggaagaaaagaaagaggaattgtatgccatatccagcaagtaataggcctcaatgttggaggccagagaaaactgctacctgcaagatggaatagtttgtatgtgtgatatttatatgtaacatatataatacctatgtataatattgatatatatttacatataacatatttatatttgtatgtgtgtaatacatacactatatatgtacatatatacatatatatgtgtatatatgtacaatatatgtatatagtatatatatatatgcatgccagttaggtgtggcttataggcaaagcacataattgacatcactcaaattctgcaaaagttgttatatcattctacacccttcaaggtaagagacttaggaatgaggtgccacatcctaagggaaccgagagccccataatgttttctgtatattttgaacatttttcataaacctatgcacactgacaaaacacttacttgaaagaaaagacactcctgttctcattgctatcagataggaaataatggcacagtggacaaaacaatttattttttaaaataaactctgtcccactacaggtgaagttccacagagccctgagaggatgttaagacatgtcggatatatttcatacaagtattcgagtcatggtttcagttagtaaacagtaatgaatgcatctgttaaatgtgttcaagaatgaacaattcaaggctttccattcacagtgaagatggggagaaaagccacagagcttttgattgctgctgtcttgaccatcatccagaggcaagaagaaatcttatggtgtgttctagtgctatggcctgtgtccatgtacatcagcaatcctctgaccccttgtcctcctgatattgcagactttatttgatgttggagttcagcaggtcacagcaagctgggttaatctagatggtgccaatgtagataatgacacaaaaaaagtctttcaagaagcttttattaagtcattttacagattcaaggaggaattttatgtatgtatttatttattcattcatgcatgcatgcatgcatttattcatctttttcttttagagataggaactcgctatgttgtacaggccccaaacagttctactagcttcacacaatctttcttcagtctgtagagtagctggcattataggtatgagccactgtgcccagtccaaggaagaattttgaatgtatattcctgcctttaaggagctcacagtctttagaagagaaaacagagaaataaacataatttaattgtgatcctcgtaggttattaaagggttttaatctaggtaataatactgttagatttttactttgtcaataatactactaataggatgaaagtaaattcaaaagggatgaattagaggaggaaggtgatgacaataggtcaggagagagataatctaagtgtggcaggggtgataaaaaatagatggatcaccaacacagggatgttagaaagacagagttaccagtactcagagtccaattaacctgtggatatttgacttggggaactatcagtgccttcttttccatccgtttctaagtttctgcatttttaattaatgtgatcatcagcaatgactcacgtttaatgcagtgaagtcctggtgcacagttcagcctattagcactaaagtggtacttgcacagaacagctctgtaggggaggaaacacgctgaggctggatgacagcagagtgtctaagctacgcttcttttgtaccatttctctgaactcctcatgcctgtgtctaccctgggtcccacagctctctgctcagctctgcagtatggctgtgatatagctcaggctactatgcagtgagggtctacagcaaggacaaaggtctgaactccctcctcattgtagtctctggacatttgtgactctatcccgagaccttgacaaccccccaagtattttatcattgctagagtatgtacttaactcatgggatgcaataaaatatatgcaggatgagttgagaacagcaaagccatgtgctgggcagagtctgggaggttggttaggctcccacagaaactgagtgactcacctctacaaagaagctggcagtgtgagtgattagatttatgccacagctaattagtaaattgaaggagtgggaccacccaagaatacttagaaccctgactgttagttaaattcacacatgccagtgatcgaatatatttctggtcttccacattagatgccagctcttatgggaccagagccagtcctggttatataatagaatgtttccacaccagtttggttcagtatcctaaattggggctcttgttatggggtagagaggaatgaggtcgacataatgtatttggtgtttggtgatggcaaagagtacctgttcatagacacacctggttgttcacctctggctagagaccaacccaagttcaactgtagagaagtccattttggtctttactggcccagccagcctctacatgagatcattccctacaacaaggggcccaggattcctcagtcaccccagcaccttttcctgaggaaaaccatctcatgaagaacttgccactgatgattttctcctacctgtgcattgaagtcagtgggtttctaactgagaactggttccttttaaaccttcttaaccttacactgtatatgatataaaactgtaggcagttcagagtcaccaataaagacatcttttggggtctctacttggcttgtaaccacctgcttatccacagtattatgcacctagcttgtcatcaggcagagtcaccagcagccacaacacaagggtccaccttcatctttccgaagcagcaggcagtgtcactccattttgacttttctggcaatactcacacggattgttaaataatgctgtcaacagtgtcatcttcaaacccaaagcaaagcttcctcatcatctgtagttagcagcataaagacggtgatgatgtgtaacataaacacactttgaaatctgatgcaattgaccctacgaagagagtattccttagtgccctgtctggcaactcctggagagaccaagaggccttgggccttagagcacttcttcagcctcagctgcaaatccattttttctagttccttgttcccaggatgaagccacagtgtttcatcagatacatctatcaggaatctctgtttctgtctatataacaatttaacttaagcctcaacctgcacagtgtatgcatcacatttccatggaaggattgcaggtattagaagatgatggatcatgtcttgaccacaggggaaatgtttcaggatgtttttatagaggctttcactaacaagcaggacatgggattggcagagaggtgggggtaggaggcaggtgaagggtggcatttgttgtgtgtccctcttctaaatgaagttataatgacatctgtgtttcaagcgtgtggaaagtttggattgagcttgaaataaatacaatttaattggtttcaaataactgaacaaaatgaccattccatgccctgtgtaataaaatgttatggaattaaaactaactagatgttaaaatccatgaaggatattttgcttgatgcccatccttcagcattctgatgaggatcttcatttatttgttgaattaataagtgaatcagcatctaaatcctgacctttgatttcctcagttctctcctgcaattgtcactgatgctctcatctccagtcctgagcaaggcaggagttgaattagtatccccttatagtgggaggggtctagaaatagctgtgccactttagaagctaggctttgtgggcttttcctggtgatggaatgattttattttcctgctttatactccagttaccaccaagatcagaattctgccctaaacactaatgtgtgagagcctgatgtccttcctaagtcttgtcaacctctttccaggtgactgaactccgaaccccatgcaccagtcaccaacattctgcattaagtgacccggtcacccagcaccatccccctgacaccacctttatctctacaccacctacctgattaaatctcctcaaatattgacagacataatgatgcctgaagatcccaaatccaaattttctttgcccctttggacattgaactttagattacaaaagaccctgactagggatcctgtggatagctgagtcaattttcttagccccattccttaaatatcaagtctttctaattttccaatgagagcacatcttgaagtatgacactctcaagttaaaagtcaatttatattaataaaatccttaatttcttgatttctgaatttgaaaaaatgacactttgtgtatcttttatttttctggcaaaaccttccaaatttgtggaaggagaaataatattgactactggataaccatgtgctatgtgtaaatattaacagatttgccttagtggacactgaattgatgatgtttgccacattatattttacagagccttggctcttccaaaaatgagaggtcatttttcaggggaggaccattttgtgtttggctaacatttaggacatataatttcttctcctctacgtgccactgacccactgcatccctggttggagcaagaagagccatgctttccttaataattgctgatggtgaaacgatgtattgtaataagagcagaggaatagggaaacaggagaaagatagtcagttgaagagtcctgccctgtgtcagggcaccgtttggccagctgggcttgctaggactaaaatatagaaagtacatgaagcttcatactcagacagctctggctacgttgaaaactggtatatcatggtgcccagctttctttgttagctgggccagcatcataccctctagtatttgctctgaacttcataagcatggttgactagctttctcttcctctgcagttgttattcagactgaatagtttctaagaaggcttttattgagaaatagaaggaggtaagttaacttctgtgcatatcttggccatatttgcttgagaaactgatgtgtatactatagccattatgggtgtgaaaggcaaaagtataagtgctctccagtatgacctggctgtcttgtcttacttctatatttgattgctaaaaatatatattcttaggtcaaaaaactcactttaagggaaaaaataaaagaatattaataaccaaaatagaagaatattaagaactttaacatgagacgtatttagattaaaaccatctctttttggattttggggggtgatttctctgtttgggactgggttgctattcacccaaaggtggaaacttttgatgttggggaatgccactgatgccttaaagcagaggataaaaggaaaagactgaaattccaggctaaaagaggagagtgtggccacttagccacaagttagcattcaataaatactgtataaattagagatatatttctgcagttggttgatagaagcttactatgatctgcctcaggatgcatcaaattcctctggtactttgatcctattattgactgtcacttccttgggggcagcagttaatcaagcagaggcttatcctgtcagagagtaaagggagctatgaaggagctcgctgggaggaaaaactggtcctcagagatgcttagggtttaggaccagtaagaggcagtctccacaccacccacatctgattcctgtttccttcttctctgctgtggtccggagaaacagtttagattaggtatttcagagcagtggtgttggactttgtcaaaactgcatttgaatcccatatatgaattgtgtgactttttaaaggttgagttccccagaagtaggatgctgaggcaaggattcctatgaaagtgaattattagaaaatggtccagggagaaagcgataggagagtaggaaatgagactgggaaggtaaagaaaccatcctcaggaggatgcgaatttctacacgctatcagttgtccaagtgcaggtaaaactggctccagcagcctgagagcagccgacacagagacacaggaccagagtgcgggattgaaaccacacatgaagcctgtgtgcaaaaaaaaaaaaaaaaaaaaaaaaaaaaggtaaagaggggctgggcgcggtggctcacacctgtaatcccagcactttggtaggccgaggcaggtggatcacgaggtcaggagttcgagaccagcctgcacaacatgatgaaaccccatctctactaagaatacaaaaattagctgggcagggtgtcgggtgcctgtagtcctagctgctggggaggctgaggcaggggaattgcttgaacccaggaggcagaggttgcagtgagctgaggtggtgccactgcactccagcctggtcaacagagcaagactctgtcttggaaaataaataaaataaaataaaataaaataagacaaaataaataaaataaaataataaaataaagtaaaataggcaaagagatgaatctacatcaccaaagcactgacagcatctgctacagtgactttggtagtttcttacattctctgagcctcagttttcttatctgttaagtcagaggaaaatgacttatttaaaaaggcttcagtgaggtaacacaagtaaagcacctattgagattagtacacaggaaaagcagttactgaatacaattagtcagttggtaattggtaataattatgtataattcctataattataggaagctctatataattattctatataattcctataattggaattaccaataggctaattgtgtttagtaactactgttattgtcctcaagttgagttattattgcaaaccctgaggcctaaataaacatgcaaaataaactgacttgtggaattttatttataacaatatatgtatgcctaaaagaagtggttcatttgcacaaggaagttttagaagctacagataattttaataatgactacagaaaactatcttgaagatgtttctaatgtttaagacatgatagcataaacctttataaaacggaatactgttctatagttatagttgtaagaatcagtgtttagaggatggctttgatgaaattgtactgctctagttcctgtgcttctaataaaattaaatctgattaatacagcaagtaggtctttggtaagttgattctgatgctgggagtgattttcttaattcttgctcagaaagccatccatgagaattaaatgagatagcatgtacaatacctggtatagttactggtaagaggtttttagtaaaggtcagtctcctctttgtttaccttctcatcaagagaggaagaacaaggaaaattaggttgcttttttgagaaaatgctttatgccaattacaattatctgaaagtagaataaatttctaggttaggcaagactagagttaaaacgtgggtgtgcagagctgacctgccagggtactctatacggaagtacatggaaatgtatgtgcaaatacagtttcatataattgttttgatcatacacagtttccacatcagattatatttgaatgactaattcagcaaatataaaaaaggcagaaaaccagtggacaagatgattcctaaggttcctttcttcctggtctatgccctagtgtattatttgaattgatattcggtggaacacagagttactgctggagattgagttataaaaagattcaaatgggttactccattatatctacttaggaaatctttttttaaaataactgatagatgttcagtttgagaagcaaaaggtatttctggccatccctttatagttgtgtacatgactgcagagccatcatttcatgcttacttccccacattcatgtaccattttctcaaaggaaaatgattgaattaacttgctagttttgattctggggtttgttttaagcaactgatatttaaatccacctagtcctctttagctgttctcctagaaactttaatattaagaaacagctgaacttacacattttgtaaaagagttcagacaatgaattccttcttcttgaaatgcatagaagtacccaggtgctagctatacccaagagccttttctaaatacaaaaaggattgacaaaccaagcattcatcctggctgggtccaacagttaggaatcaaaccatgaacttgctattcctctgtttgtggttaacttgtttgtatatttttgaggaagatgattcaatgcaagaagtagttttatatagtacattaagtaaatttcctataggatatacttaatcagaaaaatatttttggactagagctcacagaacatatgtttacaatagttttcagaaagtgaggggctaaatgaggatttctcaaccttggcactattgagattttaggttagataatttttctatggtgggaggtgtgtcctgtgcattgtagcaaatttatcagcatttgtgacctcatacccactagataccagtagcccccttctcagttgcaacaaccaaaacaactatagacattgcaaagtgtcctctagggatcaaaatggctcctgcttgagaaccacagtctagatctggtagttgcatattgaactgacagtccccagaattgttgtggggatcaaattagataaaactcgtttatgctttttaaaaagtaaaacaaatacatatagttacattatacctcttcttttcatttgttagtcatctaagattttttgagcccgatgatggaacccataaataaattaaccttaagaggctcaaaggtttgccaggtaaacaaagaggttagaagaaaaagagagatcatatcagatgtgccttaatgaatgtctgtatgtaacacgtacaaaaagttatgggaaccccaagaaaggaaaggctctttttgaatgaaatcagagaaaaccaactggaccacacagttgaagctccataataagaattaccaagtaactaattgtaactaaatactctttcatacaatgtcatatatccatgcagtttttaaatctagaagtagttaaggttcatgattatcatttctcagggacactactaaagtggtatcaaatctaaatgagcaaattaagaactgaagttgttacagacagctgttaattccctttttcatacctgctccaatgatagccaacaatcaaacaaaaatagtaaaataaaaacgaaagcaaaaaatccaactcagatttcactaagtacagcaataaatatcagagacattagggaataataataggtcaaagcagaaattcattcctcagtatgttcttcaagtggaaaaattaggtctgttttagttctgttgattctaaaagaaacactcagactatcaagaaaacctgttttaaactctaaatctgacactgtagatagatagatagatagatagatagatagatagatagatagatagatagatagatagacagatagatagatagatagaattctgcctaagtaattatctgctggtaccaaagagattgacgaagagattcactaacctaccagaatttcccaaccttgttccgggttattctacattaaatattcattaacaaggaaattccacataaaagctggtgtgcttgatggagccatatttacatgaaaggttgcagcaatttcttctttaaacctcctctacaatttgaccaattccatgttccagggagtactcagaggttgattaggacatgatttgttagcttagcgtgtgctgtactaatggttatgagtcacatttgttttggaagatcacccttaaagcctgtcactcatgcttgtttatgggaaacgcaacaacttaaacatcagctaacaaatccccatgaatgcatggtcatatttgagtgcttctaacaaatgcttcctttcatttctcccttgacagccctaagaattaaagactagtggagcaaactgggagacatccatgaacatttattaaaggaagcataggagagtgtgataactgcaaagccagctgttgatattaatattattggtgtgagattaaatttcatcagtcttaaaacctactttttaccaccagaaaaatcaatctgccatatttaaggttacattaatgtggaacattccacatactgaactgtcacatgcctttaaaataaccatgccttgctgggtttttttttttttttttttttttaatcattacaagtgaaacaaacagctgacaggtggagatctattggtatattcaagtttttcatgtgaaaatatcccccaacattatttgtaatcccaacttgattatgagaaacaaacataccatatacaggcagaagtatgtatcagtagcctttatatttggcacctcactataaaatccatattatgtttcagtgaacatatttatgtcttatacctgagtttctggttgccttcagctttcctcacttgaaaaaaactatacttaaaaaactataatttaatattaaagttaattaacacagcaaatatttattgaggacctattatctaccgggtactattctcagtgcttgcaatgcctcaatgaacaaaagagataaaaacctctacggtcatgctgctttctttagtgagatatgtgtgtgtttgtggagtggaggacatgcatatgaggcagacaatagactacaaaaataatatattatctagtattttataagacagaaagagctatggaaaactgccccatttgttcctcatctgagtatacccaaaagttgatcttgaatatttcatatgaatctcctaggttctaaatgttagaaactaattaaaaataatttgaaactaaactaaatatctttgtgatctctctggctagaagcctcaggaccagccctcactgtttactgatgaggaagctgaggcccagagaattaaatgatgtagccaagatttcaagcacttactgtcagaggtaggaccaagacatacaaccttcttctctggtgtgcttttctcaattggttaacatttaacagcaagtgctttggttgataaaatttatttgaaaatctgtttgaaacaggacaaaataagaaatacctgcttattccctcactgcagagttgtcatcagcagaaagaagattttgaagtgtatgaattatgttcagacaagacccttataaaatcactctcctctctccagtggcagaagtgtggcccctgactcctcacccatcctcattcatctttcatatttcttgaaaatcaccactgagtattttccttctgcttcctgcagcaccagcagaaaagatgaggatgggtctcttgattgccatcacaaatctctttcttattcttgcttccattcttattctgcacatatcttggacttggccatcattcttagagctccactaaattatttgattaaaagattgtttataagtccagagttagaacggaattgaaaaggcactgcacattatgatggagaggaataaactccagtcaaaagtcatggcttctggactcaccaccctaaggcagcctcactggaacttggttttccaaatgtcagtggggttttagaattttcctacttgcaagcttgttgtgaggattaaacggttgagagagattgtgtctgttatggaattgtgaaaactgtaagttgcagtccacactataaaaatcttagttacctctgtcctttctctaaagacaggttgctagtggaatagacaagtttgccattattttgaaggttgtattacgcacatattatgttagtgaagttggtcgtctaaaagttggaagggacctcagaggtcctatattagaccaactgcggttattccttagaataagctgggagttttctgaaaaatacaaattctgaagcctcatacatagagattctgatgtggaagatctggaattgatggcagcagctgcccatctggagctgctgctgtgaagatgccagctatagtgggggaggtgcggctggggctgtgccctccacagagtgccaggtgggaaacctgcccccttctgagttggcaggtctgaagcccagtgctcttcaggcacggttgcagctgcccatctatggctccagacctgggcatccctgcgctctcgggagcgcaggaagcaccccctgctcctgcaggcttggaagtgcctgctgtcactccctggcctctccctgctcctgcacccagcacccgctctggagtgaagcaaagtcgtggccaagcctggatgctgtcatgacctggacaggtgtgcacacactcggggcagtgctgacacaccagtcccctggcacattagcactctctggactttggacaccagccagcatgggagggagactgagggggcactgaggggtggttcagtgcaggcctgcaggcgttccttggcatgaacagcctgggtgatgtggatgacatgtagatggtggcaggaagcagacaggctcctgggcagaaagaggccagtccccagtgaagctccaccttcaagccagggatggccggaagctgggtggccgagctatcagttccaggtggagtccttggcctagagtgagaacttgtgctttttccaggtctgcccatagccacccatggaccaataagcacacacttcctcccttctgatctcataaaatccctggacttattgagactcaggcagatgtcgggatgacctgcctatggataggagctacccactttaggtctcctgagaactgtactgtcactcagtaaagtacttcttcaccttactcaccttccagttgtctgcgtatctcattcttcctggatgtgggacaagaactcaggacccacttaatagcaggactgaaagaactgtaacacaaacagggctgagacatgccttccctgcccaccacattgtgggtgacaagaagagaagaactgcagccctttggggagcccagacctgtgtgacaccctctttgggggctctgcggtttctggcatctccaagctcccaggcctcatcacattcccctcgtccagatgcagtcgcccacagtggaagccatttgtggtgtatcagatgcagccgcaggcttgcatggagctggtgcctgtgctggtgcctggagctgctccatgcaattgcaccttgataattgctattgccaagcatcgacagccccaccatggcagctggtgtacctggctgtacacagtggccggaccccatgcttacccactcacgcatccctcattgctcctcacctggcttgcccttggcaggcatagggtccaggctggtagcacaaaccaagcatagcctaccaggccattggcagaacaagcccagtgggcccaagaaaaacttggtcaaaggtgctaccagccacagaaaggaaacacaaaggtttctggctggaaaagcaacacctgaagaatcctgcaacagaatgatgctctggagtgttttctgtgttaggtgtgcttgtttgtttgacaaaagctccaaacgtgagtctgaagattagccagtttgggaagccttgcttcagctttctactgacattaaactccttctcctctcccatttctgtcttcacttagaaatggaaacccactaattactcaaaatctcaccttttccattcagtcacctaggcccttgcaccctcattactttgccttccaccttgacaattgctattgccaagcatcgacattaatctattttgacatcttctttccacctgctgccctctagtggaagtgcgacaagcagcaaaatatttaactgggaacagcagggaagtgaccagtttgagctggccagttcacacaagtcagcgcaggtccccagcatgatgtctacagaccatggctatgccagaaatcgttaagatggcctcaagctgtttggacgctatttgcacacaagttacatttagagcagaactttgtaaagaccctggcatttgttcatgggctttttaaaggtttcaaaaatctatctggaaaagattacctttgggatatttttgtttctttgtccctcattttcttcttttgtcatttacccaaattcttcttcttgcaaaagaaggtggtcctttcctgccttccctgacctttgaattgtccaaatcttgcaaaaaataaagatatatatatattttttttaaaaaaaattcttccagtttagaaccttccagtcaccaggtgaaaggtattcacatgaactgaacattgacaatgtaaaggacactgtattctcctagcattcctccaggtctctttgaggtccgttagtagtcttcttttttccaggaggcattgaagttaagagagtttaagaagattgtagtatgtcacaaaacaagtggaaaagctagcactaggtctggctgatggaaaatccttacgtatttttttaatgtgcttgtttggtgtttagcacattttttaatgtgcttgtttggtgtttgattatttagtcttctatgaagtaataaataataacttccatggtaaatgttattaaggctcatggtactatatagcaaaaatcattcagcttttttttaatgaatgtttaataatcagtgtgtctctgcataatctccaattactccttttagcagaggaacatggcagggatgggggtaagtttgggtaggaggaaaagacagcaaaagccacagcactgaagcaaagttgagaccagatttcacaaggcagatgccatatactccctcaagctttgaagaaactaaatagttatctatgctaaccaacagggtaggactcgtactccaaaaactgatgtaaaccgtgtgtgtgtgttgtgtgtgtatgtgtgtgtcttttctgcacaattattaaccctttttgtgtagtggtttttcatagttttatccttgattgttaatatcatggtaagtgatttgttataaatatatttttccttaagtatcataaacaatgtaagatttcatttggctgatttttcttttcttaatattgcatatcattattgttagaatacgcatacagattattcaacttcttaactagaatgtacacacacatgtgcacgtacagaactgccttccatctctttgatggtagaaaatatagctctctatagtaagaaaatttactttgagtctcagacataccctttattctctgcatgactgctcggaaagagtaatacttaggatctggattccagttccctctcctctgaccattttaaaacgttgttaccttggccaggtaaatacacttctatgaacttcaatcgtgcctcaattgagcaggctagtccaaggctagtccttggactagttcagctataggagctgaaccttgatttgtggcatagttgaagcccctgaatagtcagatgaaaatcatattaattaaaattaaatagttattggttggatctggtttttcactggcctgcatgaatgatgttttgccttcctttctgatactcagctcagaggctttcttcaattgggttttctttcttgtagtttctctggttcatgaatagcctatagacaaacactatacggttacaggtaaaaggaccctagactaagtcttttattaaacaaatagtcctgtgtaaataatgacatcttattttatgtgtgtgagttttagttttagggtgtagggcatgtctgacatagctaaaggctgagctccaggcagccagctgctatccaatctccacatctggaatgttccaaaaaacctcctatgttttctttctgcagctaagctctgatgagcaagatttaagaagtgcagccacacacttttggctgcacatttttaaagtttgttattgtcgtcatagattacttgttttgaatcaaaactttttaaagaaaacttaatctcccaaattttaaccctcttgaagtttcaggattcctaggaatacttttattttaagatgcataaaatactcagtacatgtacaaaggtaatgcttataagaaacttggggaaaaaataggggagctagtaagattgagaaggggaagaatatctgagctaacattactaacctggcgactattataggtggctggatagcatggaggcataaagccaaacactgttaagagaatagactggatttgaatcctggctctacctggattcgttttgtgacctcagagaagttgcttcccttctctgtgcctcagtttcttcatatgtaaaaggagataactatagtgtctagcatacagaattattgtgaggattaaataagttaatacatataaagaaagttcaaaactatggcgcacaaatgcttaatatatgtaagatattactgttataaaactaaagaaagagaacccagaagacattcagtttggtgggattcagatatgtgttttcctttcctcctcctcctcctcttctgccatctctaaccccactatgcttgccttccaatctatccctgcctcctatttctcttcctccctgtcgctaaaaatatttagaagaaaagaagaggtgcatacttcacggggtgccaagcttttgggtaaagtacacttttcagctaacatgactgtatccaacagtaatgggctttatggtaagagaaagctttttttccaataagtgggttttagctttttaatggatcattctctttgtatgggtaattcttctggaagatggaaattggctctatgataagatagaagagttggactcaggcatctagattaagggagtatcatgtatgcttttaggagagaagtttaatctgcaaaacctacttgccttatttaattaattgttgctcttagctgctcaattttgtacaggtgacttgcatgaaagcaaaatatatgtcaaaatccaaaagcagagtgaagccttgggacttcagtgctttcgggtgtctttccagacctctgctcttcccccaccctcaccaaggccccactgacctcaaagggcccttcttgccaggccatgaattacatctgagccagagggctgggactacagccaaagccaaatgaaggtgcagaattgaggactaaaaaaagcctgagcacgtggtactgggtatagcagataaatttgttggagaaatggtttataaataacatgaaaaggggaaggggacagagggtcacaatattgagttgttgagagttgttcgatatttgaggtcagtctcaccatttttagtaacccaaaagtaatactgaagaaaaaaagctccctgaataaaattaaccacagctgggcttattttttcttatcaagacatttgtaagtttggcagcaagcatttttaaacaggatctcttttatatgaaataaatttaaaaacatgtgtctgcagtcaggacaaacaagtgaacaaaagcaaagcaaaagcgaaaaagaagccccatgaaggcattatgcttttctgagtacagtataaggctaggatactgcagaaactgaaatacttagggatcttattgaaatagttttcttttcctccaaacaaagcaaccatctcagagggatagatgggctaaaagacaaggaataaagtaaacagaagattgataacttgggaggttttcttttcccctttctctatttggttttgatttgcttttccctcattaaaaccagaaaggataaattttggtccagaactcccaagaccagaggtcagggaaagccagcctgaggctggaagctatgaacttatcgctagtctaaactccacctccttcttccctgggagtcctgcacaaatataactgcctgatctttctgtttagtggcaaaggttttgctcccttctctttcatatgggaatattaatttgggaaagatttgcctttttttttttttttttaaagaaacagagacttgacttattcctcccacaaactctttccctggcacagggagaccacaaactaagtgaaaaacaacgtaagaagcttagacaaataggaccatatgccctcccctggagctgaaacatgcatgctccctgtccaccatcacctcgtcttcctatgcttctaccccacccctgtctcttccacactctgggtcacatgtctaccccttactgtgacttataatcacccaggaagggtaacacattgactgagggccaagcttctgataagtgaatgaacatgtcttttctccttgccagatatctatctttgccagagagggctgagtcagggagactaaggttttcaatgtcaaattgtgtattgtttaaaattgtgataatttgctttctgcactgaatctcattttcaaaataaaattatgccttaagtcagatcatactgatgcagattctgcaagtgttaagaggcttctgtgattgcatttgccagctgcaggtcaggcagtggtggatagtggtaagaagtaacctatacttttggctgggagctgtgactcacacctgtaatcccagcgctttaggaggctgaggcgggcagatcacgagatcaggagattgagaccatcctggctaacacaatgaaaccctgtctctactaaaaatacaaacaaattagccaggcttggtggcacatgcctatagtcccagctactcgggaggctgaagcaggagaatcgcttgaacctgggaggcggaggttgcagagccgagatcgcgccactgcaccccacactccaggctgggtaacaaagcaaaactccatctcaaaaaaaaaaaaaaaaaaaaaaaaaatgtaacctatacttttgcagtagaattttgaaagttcaaattcaaactcaggctttgtattttttccaaagtaaattgtattttgttcattttaatccattggttgaatctaatgagatctctctgactggaaattctgccctttttttcctccataactgacttaccagttatctctcatccatgtattttgataaatccataagaatgtctgtttttgttgtctaccaaagcctttataacaaaaccaaattcatagctttgtcaactgcacttgaaaattatgccccaggcttttcaagattctgtaattaacttcttgagtcatttgtttaaccattggtgaattcatttatctttactcgggccacagtaatgtattttacttacaacatattatgagaaactacatcacctgcttcactgaaattgaaaaacgttagatgaacaacactgccctaaaccacatttcaataatcctttgatgaaaagaaagtgagtacatttcctataatgatttgttcttagtgaagccatgttggcttcaagtgacctgttgtttcctttcagggcttacggaaataatctaaccattctaaaatattgatggggatttgggtcaaaggtatagttttaaaaattcaccatctttaacctgttaaatatccaaagaaataatcatttattatttcatttatgctttcagtatctaggacataattaatctaatattgaacatttgaacttattgttagctttgaaaatatgccctattcctattggctttatactcaagttttcttaatacattccctcaatcgtctccagtcttgttattgcccttgcccaagaagaagaaaattctgtaagagctttcttttgccttcctttcttctctgagtggaataatcttttttgttgtttttatagtattttagagtttcgcgagatcagacaaaaattacctcagcttatagctttatcttttaagtggaagaactctgaactattattgtgtcgtcttgaaaaaatagtctatggaatatatataggtagttgtgttattttttgcagtgttaagttcacctttttcttctttttcttttagtgcattgtgaacatttaaaaggtcatttgtgcagcatataagaggattgacaggtttccatgcatgatgcttaatgtggaggtgatttctttccatcaagttattaggtttggaataagtaacacatcttaaaattacaatcttgatgtagcaaatcatcaggtgggttaccattacatggaaagacccagtaaaataaagaccattaagttccggaccctaggagtctacagtaagtcattgggaagttggagaggagaaaggcaacgttagctaggcatttcattcattcctccataaatgcttactgggagcacgttgtgtccctggcatcatcctagcttcactgaaaagaatgacagatatataaaatgagtaagtgagaagtaattgctctttactctcaattatagctgggcaagtgcatctataaatatgcttttgtgttctgaacacacactaagcagttggtcaaagtagtaagctagagaaaactactttcaaatgtagtctttcaaaataaaaaaataataataataataaagatttcaggacagtttacctatgaccatttagagatttaaggattaaaatcaggagagaaggggaatgtttctgctggggaaagatttttaaactggtgttttctactcagctactcaaagtgattttttaaaattttcttccttctattacttattggcctttattgtggggaagactgctctgttggcaacatgagagagatgtgaatcaagaaaatggaaacaccattcaatattcaaaagccactatccccctaaaagcaaccacatactcagattgcacactaactggaggatgttaaaaagtgttctgttaaaaccagttatccagtttttgctacttaaactctgctgtgagaaatgtgactatagagcagccttaaaaagagatcatcttgatattaagcagtgttactcatacatgcttattgacattctaacaggtgactttgaatggatcttcaggctcagaaacatggttgtgtgcctagaactggtgactggaacaaggtgtacagaagtgaaatgaccacttgctttctctattggatttctttatccagctgtgcatgtgtttcagggactacagttgattttcttgatgcaagcctagcaacttgtttttccgttcaacacagtaaaatctgagcaggagagaactccctgttggccacccacctcacaatctttaaaagggaactctgtacagaagcattccacattaggcaaatgtacacttctgcaatcaaaatgaaaaacacttgagctgaatcgttttccgttagctttcgtttccagccctgattaaaaagaatgcagggaaccctgcaagtttaagcagttttggcaggcgaggaaacagctgtgacattgtcaagggttgtctgtaggagctgtgcaggctgctgacagtactgataatgcccagaaatggggcagacgcttttcacatttggtcatcaaaggggtggcagcagctaggttcaaaaagtgaacttttgaccctgtctgagacaactggctctcatgaatcttgttctgtcattctccagtctgattttctctttcagagcaagcgggtaggatctttggttttaagactgattgactgttattaaaagtagctagttcttatagctgcaattggaaaggatggaaggtgaggaagaagagctggtatttcccactatcctgcaggagtggggaaatctatcaatgactgttccactaatctgtggatgagctatctagggagttatcatgcagttgccaaagttttcagcatctaaaagcctccaaagttctctctgtgaggttccacctcccctctctccagacccttcccatgcccctcagattcagcacttgtccactgtccttgctaccagggaatccctctgcagccccctcaccctcctgcccctcccaaaagagttccagactttgacctgtcccttccacctcaacatctgtttgtgtcctaaactgatggccattgaaagaaacagataaactaattaatgctgaggtatgactaattaagtattatcaatgtgctaactctctcagggttatgtgcattttaatagaggaccagcagtccaaaggccggtctcactccactgtgcccctctatcagcacggagtctattgccaggcagccagtgaccaagcctgagaacttgccccagatcagcagcctccccactgagaaagcaagcaaactcaacagtttttcagtgtttcagggaggctgcagcagcaatccagttccttcaaagggtctgtggattctctcagctttcctagtatgttgctgtggtagttagttcttggagcagaagttcacaatgtgaatcttcacatgctgctctgtgtgccgagcgggtgttgtaagttaattctgcccctatctgccatcttaatcctaacaccccccatgtttgtttaatttaacttttattttagtttcagaggtacatgtgcaggtctgttatacagataaattggatgtcatgggagtttggggcatacatgatttcatcacccaggtaataaacatggtttccaataggttagtttttatgtcatcacctgcctcccatcctccatccccaagtgggtgccagtgtctattattcccttatttgtgtttatgtatactcagtgtttagctcccacttataaatgtttagtgttctgttcctgtgttagtttgcttaggataatgacttccagcaccatccatgtggctgcacaggatatgatctcattttttatggctgcatagtattccataatgtatatgtatcacattttctttatccagtctactgtcgttgggcatttaggtttgtcccatgtctttgtctttgtggatagagctgcagtgaacatacatgcgtgtgtgtctttctggtagagcaatttatattccttggattgtcgggtaaaatagcagttccgttttaaattatttgagaaatcgtcatcctgctttccatagtggctgaactaatttacatacctactagcaatataaacattcccttttctccacaaccttgccagcatctgttattttttttttagtttttagtaatagccattctgactggtgtgagatggtattcattgtggttttgatttgcatttctctagtgaatagtgatattgagtattttttcatatgcttattgtccatgtatatgaattcttttgaaaagtgtctgttcaggaacatcattcctatgaaaatgctagttaattatgcaagtattacttgtttccattaattgagttttttaaaaaccttataatcaatattgcactaaaattttcagctgtgtgattccttatcactttcttggatgcaaatgccttgtatcaggtactatatctcataaatccacattgcatctaacaatgtagacaattaataaatgcttgtttaacaagcggatttgtttttgctttattttgctttctgtgttttccttaggatgtggggcattaggccaatggaaactgtctcttaaaagttcttacatataaatattgatgtcaaagtaactatttttgtacaaataaacacatttacctaatttggtgagcatttatagagccctgcctatattcaagggcgctgtgctgatcactgggcaactgaggaagtatgaggcactgttaccgctgtcttccttcccaaattgggtcctagaccgtatcttggtagagctacctcctaaggaagcccacctgtgctattgagggtacatctgaaggcagtgcactggaatgtatagcctaggactggaatttggagtgaggccctgagagatcatacacatttttcacttgtgggggaatgtccttaactagaaatagatggtgatttcagatatttgatccaaacctaacttcctcatttgaatggagtaaactaataactgttcttgaggctctggaatagtgatgaattttcctggttgggaattcagatgctgatttctgaagcagagttttaaagttgaaagatgaaaagggaacagaacaataaactcaagcttagaatgaagggtcatttttctagtccaacttccctccacctagctgccacccaagattgtcccttagccatccttagaatattaaaataaatccattgcagtgcccaaatgacttttttctatttgaaaatccttgccattggagaatttttctatatatcttaaatggttcttcatgaattttgtcaagtttgtcagcaatgtgctcatgacagtatctcatatctatgtgtattctaccactttagcctcctagacttctagaccagcagttcccaaactttcaaatatgaccccttttaatgtcaacttctgtttataaaagtacaaaagccctcacatcttatactttttttatgcttttatttattgagatattagacaacacacacttgtaggtgacatggattcttagatctaaataactccactctccatggtcattctcacttcaacacaggttgatgcagtccttagtttggaaaacagttttgacgtaaataatcccagactttcctgtcactttttggagcttttttcttcatgctttctttgcatctttcttaaaatgtgaagactacattggatatattattaaaataacatcattactagtgctatgtttaaagctgactttttcttcctagccactgatatagcagtgccaactgtggactttctatagaatgaacactttagaacacaaacactgtcacttgtaaaacccttctttttatcagaacagcagttagactttgtgtgtgtgtgtgtgtcttgtgcgtcctttatatattctacaaattattaaagacaccaaagaccttttgtttatgtgaggttttgttattgatacttactgtcttagtaattaaatgtaagaaaatttttaaacgacacatctcattagctgtcagagcatcatcatgtcttgtaggctctggaaaactccatggtacgctcatgaagaatgagtgtgaaagagacaaatagtagcttaatgttattataataatagttggactttgtgaactcaccaatataatacatattcatgacacagtccctaacatctaaaaacttacaatctaaggcccaacataaatactaatagatgatgttaaattctagcttcacagtgcttcctacaataatactaaaaatatgtgaatttagacagaggccaaaatgtgtttaataaccacttggctttgcttagtattttattacccaccttggagaattggccctcctgttttgcactttatgagaagcagccctatgaaatgttttatcagaagtttaacaatgatgtagaacacactgtttcattttataatgatccttgggcaaaatggtataatatctgtaggagaaatgctaaatgctgcagtaaaaactcctcagaatcacgtatgtttttatcgtgtggtcactataaatcatgtaactgtgctttctgatctcctttggccaccaggaagacaagaactgacaatccatttattgtaaattcttcagggtctgatgtcattatttctatgtaagattttccctggcattatcttatttctcaggtctcatttttcctttgttctgatttatttttcttaatatgttttattgtgcatttgttaatatattttgttgtgtatttaatttccaatggggatgaatgaataagtgggaaacagagatacttgatccaattgacagggactgcttgagtatctggagtggtgcagatcaagcagggtaattgtatcaggtttcattaatgaaatgggtcttaaggggagattaggaaggaaaggaagtgggttgctggagaggcggggtgttttatgtggcagatcggctgtaatcaacatgcagctgtggagtgagtgagtgatgtcctgagcacagtaaggagatctggctgacgtggcatggcacctcattgccttaatatcttttcatttgattgaagaggcagctgagggataggtgctcttgaaaagtggagtaaccatttgtaattaaggaggactctcacttcagtttctaaaataaattagaagggagaaaatataaagtctgagagatcaattaggagaaagttctggtgctatatatagaaataggcctatctgcatatgcaggtgagagtatgaagaagaatctgtgaatggcagtcattttttgtagctggttccaattaaaattgattctttactatcgcaagaacagaaaaccaaacaccgcatgttctcactcataggtgggaactgaacaatgagatcacttggactcgggaaggggaacatcacacaccggggcctatcacggggaggggggaggggggagggattgcattgggagttatacctgatgtaaatgacgagatgacgggtgctgacgagttgatgggtgcagcacagcaacatggcacaagtatacatatgtaacaaacctgcacattatgcacatgtaccctagaacttaaagtataataataaaagaaaaaaaagttggaaaaaataaaaaaataaaaaataaataaaactgattctttataacgactacttattggctgctgctcaccaggtctgcttttctcatcattgtgtgcagaacataccacagtatacactacagagtaggtgcttcataatgtgttgaatggatgaaatgggttcctgcctccaaaggagatggaaaaaaaaaaaaacagacaggcaagtaaatgaagtgaaatatgtataaactgctttgagaatgttttataaaaaaggacagcagccaaacagcattcacagtaggctggctggagtagcagtccttgaagaaacccatggaaacagcggtagaagcaaatgtgcaatagctctgccttttcacactatagggcagcacataaatagtcctggagcaccagggtccttgtggattttttaagttacctagttggcacagcattggctcctcctctcgtgtgattaggggccaggatacaataaaaatatgttatgttggaactttgatgccagccttaacttgccagttcagcgtttgtggttgcaggtagtatcagctcctctcctggtatgattgagagactgaagtccaaggcttcaggttgaacagaattgattgccttaaggaccggtttagaactcttccatagcacttgacaggaagccagtttatttttcttggatgccagcttccaagaaaagatcagtcttgagcaaaatagttcttcactctcagctcagaagcctaattgagagggtgtcctctaagcatcacagccgactctgctagtaacctgttctacttcaacctgtaaggcccatgaggctggccagtgacatcactacaggacacagtggaggatgtttaggaatgactaggtgatgaccagggtgcagactgtgtttactcaaggctaattgagaggtactattttcagtggtgtgcttataaatgtgtaacagtactgggttgaagggaggctctgacttgtagcattttgctagtgtccatggtgtaaatacccccaacatgactaactttaagttaccaatgtgattgaaagtagagtttggaagagaggcacagtagcccactgttatgtagtacttttgccatacagatgcataagagacataagtaacctgaagaacatagataattattaaatgtagtgaaatgattatgaagtgacagattttaagtgttttatcacatttgtttttaatatcatttaattttaagttgccataatttaatttgtaattaaggctatgttaataattggcttatggaatttctgagaattcaaaaaccagtgcctataggtggatccagtacaccactaggtaagaacagcctagaagtacttctaggctcttgttctgaaagatgccaagactggcatccatggttccagtgccagcgcaaggaaagacttactaggtcctacagtattgctcccaaatctctttcagtggccagggaaattatcggactgaaggcagagtgaattttgctgaatggcttgcttatattcaggtcctagtatctatgattgataatcagcttcatttgtaagtattggatggtgcaactccatgcatccaggaggctgggaggtactgagagcagagtgatagtgtcaaaagacactaaaatgaatgccagctctctcctgccatatccactactaagtgagaaattcagtgacatagtcactgaggactccaccactgctgggtgttggggagggcacactgaacatttcaagacaatctgggtaagatttttcttggagggattcaagtacgaaatagttaatatgcagaaatgaaggggaaattattataccccagaaatgagtcagataatactaaagaaaggaagaaaggaaagcatgacttgaattctgtctttaatgatgaccacagaagaagttgggtctttaaagatgacaagagaagactgatcaggtagcagtgaggtgggaggggaaagatgagagaggggacattcctagtagaggaagtaaggtagacaaagtgtaggaatgtgaaagagcataatgtgtgtaaatattgttcaggtgacttcttgggtacctaggtactagataaagaggaattagaaataagaatggaagaaggggagattcagggccaggttgttgagggcattttatgccatgctaaggagttttgaatttttcctttcagtaatagcaagaaacttaaaatgagcaggagttcgtgtttttgaaagaactaggaaaacacctctgggcactccattacctgggaataatgggtgaaatttcccaagttagtgcacaggctgctgggtagggcttgaggctttcctcttgcctcctatttcaacactgtggtcttttagggcttgtcctcaacatgttcttaaaaggaatgtttgctcactgccaaaacagtagtcttcatatttgttctgttcctttccaaaaggtaaattgaaaaagcaacataccctcagccaaaagaattaatcttttatcacctaagttactgcccactgccttttagttttaaacttaatttagtgtgcataaatggctataagcccttggaactctctttatgtttgcatcttaaatttaccagaccctccttctatctatagttccagaattttctttgtcttattttcttcaagaaatgtatttctttaaattggattgcaaatttggaatacacacagccaaaggctttcaaaatcattcttgttaaaagggacaagttacttgagaacgtttttaaaggaaaaagttaaaatagatgtcaatggaagatgcaaatacgaatataaaatatgaaaagcatctataggctggagcttctcaggagagctctacttcatttaaagtcatattatctggcaccatttcaaagctgtgggttacttgattttgtagttagaaaaaaagtataaagttgaaatattgagctctttacatgacctttttgctaggagcagtggatgaaactatcctctaagagatcaatagctttagtgtaaacttggtcaataccttattggaagaagtaactatgtcagattaggtagaaattttagaagccagcaagtttccaaatgtccttctggaattggcctcttagggccatgtggaccagagggatcttatcacagcagtaataaactaatatctattagccaaatctagctcatggacacgttgtttggcctataccacattttttttttttttttttaaagacagagtctcactctgtcacccaggctggagtgcagtggcgcgatctcggctcactgccaggttcaagcaattccctgcctcagcctcctgagtagctggaattacaggcacccaccaccatgcctggctaacttttgtacttttagtagagatggggtttcaccatcttggccaggctggtcttgaactcctgacctcgtgattcacccaccccctccttggcctcccaaagtcctaggattacaggcatgagccaccacgcctggctcacaccacatttgtatgaagttgaattggttatttttaaaaatttgaagaatttaacaacaacaacaacaaacttttgtgtccagcatttttttttttttttaactattgggacaatcctgggcctgcattctttgaacagttggctacacttaagtagctgctgccccttttagatggggcaagcgttctctactttttcacagtccctttcaagggtgcttcagccatttttgatactcacttggcttcaataaaccaaggtcatgtttaaaagattaaataacagttattacacacgcaccaaaccgtcagagggaaccagacttgtgtaccagaacagagtcctggagcatatctctgttaggctagacatcactcttttagttatgggatcacggaaaggtgcagaaagttcctgggaaggggttgggagggattctggaggatcccaagtgtgactcacacacttggaggcttgagtcaatagctttttaccagctagcatgaaagtacttctagtgtttaaaaacctatggcacagtgggatcttctaggaaagtagaccctggagatggagattcgaatatagcacatttattaaggggtgccactagtatcgatatctgtagaagagagagaaaggatgtgagagtgggcagagggagaagttgagctgcaaagcaggcccagtgccagcctcaactggctccatgaggagctctggagctggaatgcccgtttatatttgtttcccatgggatcaagatggccaggccattctactctgacatgcatcactcattgaaagtggaaagactcttgctcttgaatgaggcaatcctctgccactgaggcaatccctcaaaggagtaagaagtgaaagctgttggcctggagcacctgcagcatctgaaacaagaaatccttcattgaacaggatctgggcagcacaccagagtaatcacagtcagcagctgtaccagtgacaacagatgaatatcaactctgcctttagcccctagggtgtgacacctggcctatagcttatccaaagctgtgcctaaactctttggactgattcagaatcaagctagtcctagcctaaagagaggagtttaatgtcatgctacactctaacccaatatttgctggcttgtaattcagtcattaaagaaattctttttattttcacatagttttagattgtcaaactgttaccattctgtgttcagaaattgaaacctattctttctattctttttttttttttttttttttttttttttttgagacggagttttgctctcttgttgcccaggctggagtgcaatggcgcaatcttggctcactgcaacctccgcctcccgggttcaagcgattctcttgtctcagcctcctgagtagctgggattacaggtgcatgccaccatgcccagctaatttttgtgtttttagtagagatggggtttcatcatattggtcaggctggtcttgaattcccaacttcaggtgacctgcccccctcggcctcccaaagtgctgggattacaagtgaaatctattcttatattttactgtaacctcagaaaagaatgcttttttgaggactagaattctgtctcttttgttgtcgtctcctttctctttcccaaacctgtaattctattgtgcttaccacacaatgaacaatcagatgtcttaaactgcggcttacataattaccagtataacctttttgcttttatttttttctttcattttaatctgttcatgaggactgttacccaggtattttaaaaatctcactccattgttttaaggttagtggttccaaagggattttagagaccctgacccaataatagttatatttttctaagtgattctgaagcaatggtcccaggtaagaaattgcagttcaaagcacatcataggtttgttattttccaaattcttattaaagcattaatgcaaatggaattttcctactactcctctgctttctctaatctttgacaggattaattgctacactataatatgatttgttataattttatgtttatattaaagatatagaatatgattgccctttgatgtcaaatactaaagattctgctactgttttagttgtgctggttcttatcttccttatctttcattcaccttttcaattcatctcataaacatttaatgaaaacttattgtatatcaagggttgtttattataggaattgtaattcaaaaactttctttctctggtctgaaaattttagaaacataaaaggaaaaagggagggaggccaactgagagtataaaaataaatatggcatttattaacaattaaccagtttcttttttctataataatttatccagtaaattgtatttttaaattattgttttagtttttgttgcatatgtttaaggaatacaacatcatgttttttataattactagagtcaagcaaattaacaaattcatctcctacatagttatcttttgtgtgtatgtgtgtggtaagagttccagaaatctactctattaacaaatttccagtatggaacacaatattattaatgatagtcctcatgctgtacgttagatccctagacttattcatccttcataactgctactttgtaccatttgaactacattttcacatcccctgtgaaaatgggagggggacggtacaattcgcatggaatatctttttccatcacttaccttttagtgtatgtatgtactcagatctaaactgagtttcttgtggaaaccatacagttggatcttcgttctttacccattcggccgttctgtatctttttattgagggctttagaccatttacaatttaagtaattattggtggggacagatttttttattattattattatactttaagttctagggtacatgtgcataatgtgcaggtttgttacatatgtatacgtgtgccatgttggtgtgctgcacccaacttgtcagcacccatcaactcgtcatttacatcaggtataactcccagtgcaatcccttccccctccccgctccccataataggtcccagtgtgtgatgttccccttcccgagtccaagtgatctcattgttcagttcccacctatgagtgagaatatgcggtgtttggttttctgttcttgcaatagtttgctgagaaggatggtttccagctgcatccatgtccctacaaaggacacaaactcatccttttttatggctgcatagtattccatggtgtatatgtgccacattttcttaatccagtctgtcactgatggacaattgggttgattccaagtctttgctattgtgaatagtgccgcaatgatttaatcttgccattttgtcaaccgttttctatttgtttatgattcttttttctcttgctgtcttcttcagtgttttgttggtttttttatattgataggttttgatttcttcttttgtgtaacttctatatattttttctttgttatcaccaaggggcttacataaaatattttagagttgtaactgtccgatttatgctgatagcaacttagcttcctttgcttataagaactctctgcttttacctcttctcccccattatatgctattaatatcccaatttacatctgtttatattatgtatctagtaacataatttagttatagttgttttaatacttgtgtcttttaatttgcatagtagaatgaacatagttacctaccactgttatagtaatacagtattctgtatttttttttttttaccatgttccctactctactgctttctttttgtttcaatttgaagagctatctttggcatttcttataaggcaaatctagataaactctctcggctttgtttgtctgagaaattctttatcttgcctttatttttgaaggacaggattactgggtatagcagtctttgttgttaggtttggtgttttttttcttttttcagcacttggaatatatcatccaacttccttcagacttgcaaggtttctgcagaaaaattgtctgataatactacagaaattttattataagtagcaagtcacttttctcttgctctgctttcgaaattctctttgtcttcaacttttaacaattataatgtgtcctggtgcaggtctctttggattcatcttgtttggtgtcctttgggcttcctggatctggatgtttattttcttctcaggactgggaaattttcagccattatttctttgaatgtttttttctctctcttcttcttttatatattccataatatgtatatgagttcacttgatggtatcccataattcccttaggctatctttacttcttttcattcttttttctttttgcttctctgactggataatcatcaacaatctgtttttgagttagccaatcttttcttctgtttgatgtagtcttctcttgaataccttctgaataaaaacaaacaaactctttttcctctgctctcacagttcaacaacaatcagtaaggaagccttttgtgacaaaatgtgtgtttggggaaggggtaatttccttcatacaacaagtaagcaatcagttctgcagtaaataccaatttggtgtcctctaattcaattccaacacttctactgagagatctgcagactgggagctcagtccctgagactgtcttcctcaaccaacttccaatgccaattgcaaaccccaggttattttgcctgtacttcttactgactggctataaactggggttcccacaacccccttctcaggttcaattaattttttagagtggctcatggaacttggaattacaaagaatattttaagggatacaaataaacagccagaagaagagatgcctagggtaaggtcaggaagggtcatgagtacgggagcttctgtccttgtggagttggggtgcacaacccttcggacatgtagatgagttcttgttcaccttcctgtaagccttcacatgtatagctatctagaagctctctaaatcctgtactctttgaccacttatggagacttcactggaaaggcatgattgacaatcatgtggaaatgtgattggacaaaaaaggtattagctagtgctaacagactgaatggaaaacccagaaaggcctgtctgttcagattcttcctggtctctctctctgcagcattctttcctccagtgaatggggcaggaccttttttgaaatgaaaatcttatgacctgcaatcagacaaagtaggtcagagaatttctttatggccagaggcagggaaagacttaagtgtatttttagtttctgttgcctgccttctggagaaaaaggaacaggtgaatagagggtaagagaaagtcagacagagagattctgtttttgaggcctgcttctaagtgtctaaagcaccccagcattataataaaagactgtaataagagctaaggaagttatgagccaggaaatgtgggcaaaataatatcacagccctctattattttttatttatttattgtattatttatttatataatttctgtttggtactttttaatattttctttttgatgaaatctcacacagaccatgcattgctctcataaactcagtgagcatctttatggctgttatttttaattctcggtgaaatcggttacctccatttcattagggtcagtttatagagatttatctagttcttttgtttgaaacatattttcctatttctttattttccttgactacctagtgttttctttagattatataaaataagcatccctcccaatcttgtcagattggctttgtgtagcagaggtacctcaccaatcaacttgaccagagatttagggtgcctctttttatttttttgagacagtttcgctcttgttgtccaggctagagtgcactaacgccatttcagcttaccgcaacctctgcctcccgggttcaagcgatttccctgtcccctgtctcagcctcccaagtagctgggattacagccatgcaccaacatgcccagctaattttgtactttttttggtagagttggggtttctccatgttggtcaggctggtgtcgaactcccaacctcaggtgatccatccacctcaacctcccaaagtgctgggattacagatgtgagctacagtgcccggcctggggtgcctcttaaacttttgtgcttattcaaaccaccagttttgttcttagtggccctagataggaaggtcccaagtcctaagttagtgcccaaggtagaaacctgtcgtccctcaagaagcagctggaaatgttgaggctctagatgagtggtccatcttcctctctcctcagggataagctgggatctggactttatgccgcactcaccctgcagtaagccagagagaggatcggtgcaaaatgcttgtgctctgtttcagacaatgcagtctctaaacatttactttgctctctcatccccaggagacttgcaaatggcaagtctccttagctgtcctggataagaaaattagctggaagcttggttatgtttctggagtgaggagctgcaggaagtgccctcatgcctgttcagactcccggaggtctactaattgcctgctccatcagctccctgatgcaggctaattaatagcttaatccacggactgcagctaggaaagtcagaatattatgtacgtagtctaactccatccagggagaaactgagagctaggtgtttttgcttgatcactctgcactgagtttggggaactagctgctggtagtgcacttgagctcatttaaaaccacttctttgttccttgcagtcttgggggactcataaatgctagatccccttagctcccagagctaggtgatttaagagccagtctctcaggtgggagctgtaaaagatggggtgctcaatgtatggacaaactccttccagggacaggagagattagatgctttatttcatcattggattgagctgggggagaaggcacaggaaatgcccacacactagtgcccacataccctttcaggctcccagaggtcttactaattacctgccccactggctcttagcccacttagtaatgctataaggaatacctattgctgggtaatttaagaggaagagaggtttatttggttcgtggttctgcaggctgtacaggaggcatgatgctagcatctccttccagtgagggcttcaggctgcttccactcatggtggaaggttaaggggagctggcatgtagaaatcacatggcaagagacgaggcaagaaagaaagaaagagaagaaggtgccaggctcttttcaacaatcagttctctcatagaaactaagactgagaacttacccactgccctgacaagggcaccaagccataaatgagggatcattcttatgacccagacacctcccacaaagtccacctcccacactggggatcaaatttcaacatgaggctttctggggccaaacaaaccacatcaaaacccgtctcccagttttagactatgtagagttttaatccttgggcagcagctgggaaagtttgcaataaaacccctaccagagagaaactgagcctgagggaattggagtaggaagttcctgcacacctgtttaaaattgtctccttgttctctgtggcccagagatatttgcaaatgctgagcctatctgctcccagagctaggtgaattggtgatatggtttggctctgtgtccccacacaaatctcatctcaaattgtaatccccatgtgttgaaggagggacttggtgggaggagattgatcacggggacagtttcttccatgctgttctcatgatagtgagtgagctctcacaagagctggttttaaaggtgtttggcagttccctctttgcttactttccctctctcctgccaccatgtaagatgtgccttgcttccccttcaccttccaccatgattataagtttcctgaggcctccctagccatgtggaactgtgagtcaattaagcctctttcctttataagttacccagtctcaggtagtttctttctagcaatgtgaaaacagaataagataaggagcaagtccctcagggaggagctgtaaaagctgaggtgctgtatgtgtagttccaaccctttaatttctaagaaggtaaagctaggagttgggtttccttcctgattacaaagtgatgtgcctggggtggggcttttggtatgaattaaccaatttcttaagcatcaacttggtgttccaaactgtgctaagggctagggaagaggctttgttatccttatttggagagagcttatagtctaattaggaataagaaaattgacacaaaataacagcaaataacaaggcaacagaatcagttgctacatgttatggtggtatataaataaatgatggtagaatttagaaaactgaaaggggacagggtagacaagagtagtcaggaaggctgcatggaagagaaggaacttgatttgggtatagaagaaggggctgggatttgggaagacaaaaagcaagaagagggccattccagtatccaagtaatgacagatagagggacagggcgtgtatgtattaacatgagaatagcagaagtttgatgttggttagaacttactaccaacttcttacagaactttcccttaaaaattctgagtttgaaaacattcaacacctcaatctactttcaagatttcctggcaaagtgaaggaagcaaatacctttattattttacaactgaagttacctgctttgtcagttatgatctaggctgattctaactacctactggcaacctagaacagtcaaaagacctaggaattcattcaaaagaccaaaatctgcattgtctggcagtgtgagcatgagcaaatcacttcatctccttgagccccagttttctcatctaggaatgaaaagtagagccttatctatctgaccaggttattatgctattaagttatatgagtaaatgggaaaattcttcttaaacaataatacaaattttagttggtacttttgttaacatctacactagaccacatttatataggtaatttaaaagtaaaaaagaatggggaattcatttttatgtcatggatttagattttttcatagtagaaagttaatcattcagcagtgttttttacatttcaagtagcaaccatcatattgccatgaaatttatttagtagcccctaactatttttttttaatgaaatagcataggatgaaagtatagtgtatattgtactttttagggcagtagattatatcattcatcatagagataagtgtcgtttagtgacacacaaaggcataagtgacatacacattggtcaaaatgtaaaatatatttctttttgtagattgttgtcaaagaagattgaaagacattaattaacggtatagtatttcaaatataaaatcctcagtcttcatattttgaaccttaaattatactaaccaaaaagataaatttcagagaaaagttattttatgtaaagaaagtgaaattttgatgaaatgagacatgctaccacatattctttattttattcttatgtttcttgctgaaacccaaattctgtcttcacttctgctacccaagtatagaaagcaaagggtttgctttttgcatttccatcaaaatctacatgcctagaaactcaatgtgctctattttttctggtagttcttgagttgtttattttaactatcaataaatattatgtaatttaaaaataaaacttaatttgtgacaaagtcagttttcagtctgggttcacagaagaaagggatggcatatgcaaaaaggatgtaaccaggaagagtgcaataatatgtctatatacaagagggttgatggagttaaggaaaccaaccaaggatggtgaagaacccagagctaggaagagggtactagctcccaggcgtgaaagggcacagtgttctaggttccagatgtgacactgatcagtgggagaggagcagtatgactagtgccatcaggggaaaccacagtcttttcaggaaagagggagaggcctggaggggacaggtgcctgtggctgaacccagtgaagaccaagggttctgggcaatgtcatctgtaatggccaacttcctggggcacagagcagggaagaggagagtggaaaatgaatgtggggcaacaaatggggagtaaccagcaacctatcatatgaatgatcatttttcatgtcagatggtggcatatagcttttctattcaaattcagtttccttcctctgttttctaactgttgaagtgttgtcttttacttcatgcagtctacagaatatcctgtgctgtgctgaaagaagacaattgggagagaaaacattagtgaacttgttgtgtaacttgtcaaatgatttagcaaacacttagttaaggaaatagctatacttatagattattttttaatctccatttacatgatcacgatatacctgcttttgcagtttgactttgacaagaagcaaactctgagatggagtttagtggcaggacgtttattaaggatcaacgcctgtggagaggagcccccagctgaccccacaaggagctctggagctaggatattccttcacgttgctacccacccccgactcccaccttggttgatacagtcaggcctttgtattccacatcactctgtcattggatctcagatgtaagctagggaatgtgaccttggctaaaagaggcaatccttgaaggggctgagatcttaaggcatcagacacttccttccttgaagggggttggggcagagcctcacagaatccatcatacctcccttcattcaacatacttctaaaaaaatatattgtgagataaaaatggtttccaagttttgaaagttctgcctctttgcaggaagaagggacaccaattcttgttgagaatctagataccctataaagagtaaccctcccaaagaaataaaatattgcatttttattgagacatctatgatccttggaggtaaggttttgtggatttgttttttgtttgcttggagcgctccctgtcaagcattgatctctttacgttcctaagtatgcctagaactgaaatgaggaattatcttaaatatagctattcatgaagtatcccagtcagtgtctttgaataaaaatggcccactaaaagcttcctattatttctgatgcctcatattggcagattctgaaacaggtgactaaaaaggtaaaaagaaaatcaaattattggggactcagtcttgagtttaagcataatgaggacccacttggcattaacttttagtcatattccccatcaagaaattgttctccagaaatctttataaattagatagttaagtttctaaaagatgactgtgaatctaggactgatctaccaatgacgagaactgaagaagcacttgcttaaaaaagggaagaggtatttacatggtacagaaaaaaactgataagtaaatagtcggaaaaaaaaaaaaaaagccaggggtattccaaggaaagcctaagaagaaaaaaattcaaaatgcagggacaaggataagggtctgtatcagttataaattctttttagtgcaaataataaaatatcccattaatagtgactcaagctatatgaacctttactatttacctaaaaatcaatttagaagtaaatgatctcaggttttgttagaaagcttaggaaaatcatcaagatctcaagctccttctggatttctgatccaaccccagtcagttatttggcttcactgcatcatggtcacatggcaactgaaactccagacagtgcatacacgttcaaggtaggaatatgggagagaaagtggtgttaatgagctcttcccttgcatcttcccatcttgtaaagcatctaaaggttttccagaaggcctcagccaactctcacttatctatctttagctggttctgtcacatgctaccttcagttgcaaagaatgttggaagggtgagcatgtggaaaggtgaatgagctgccctaactggcctagactaatcctgatctagcccatggtagggtactttggttcctagctgttgggtagccaaccagtggtgtctgcctgcaggaacttcttagaagggccaaagataaaggacgaagtgtcctcattgatttcatagacacaaccagttctagatcaccggttcaaagagcgtaataaattagtagagtgggagaacacaaaattaggaagattcatttctgctttattgtgatctgggtcaatttttgctttctcaatattaatcttcaaaaagatatcctttgaaatctcaaaatccttttctataatttaaaaacaaccttaccatctgtgtcctctgtcatatggtacaatattcaagagggtgaaataatggtccagtaactaagaaaagacttaggggatgaattggccttagtgactgtcactaaaatgtaaacatggctttaaaaagtaaatcagaaggaatgaaagggccttgacagctaaggctctcaggaagattctagaaagacatgaagcacaattttgtaagtgtgcgataggagttactcttcttcttttattcatgtgtcatagaagggaaaggaaatttttaaaagagtaagaccagccagatatcacaagagtatagaggaatgtaaggatagcatgttcaagggcaacatgaagagtaagagaaaatgtcctggatgccaagactagctctctttattgcaaagcttgccagactctttacccagtacatgtactctactctaagaagaagaaacaaagctaagtgactgctaagctcatggacaatgtttttgggtctctccagcagccacctagtggctgactaggtaaaatcatttgtttttctcaagatgttgtaattctgagaatgcagggtttggctgccatgttagcctggattttctgagatgcatccctgcaagagattcactgagaaattagatgtgcaagagatttatctggggaaatgcctatgagggaaaatggagaaggagctgtaggaggctggaagagatgaacactgcagtacacgtctgatcccagtgatgggaaaaaaaaaaggaaaggaggaatgagaaaagggaaagaaagaaggagggaagaaaggaaagagatagggagggagggaaaggcaaagacaccagtgcagtgccaagaaagttttggcaaggctgatggggagtcttcaaatcaaagtcacttgaaagaggaatccccttatcatccccccaggaatgggcctgccttggtgtcctcatgcaaagtcactggctgggtggatttcagagcatagcagctgaggtcataggccagttacactctgccataggaggcttgagagagcattttcatagctgccacatttgccactgcaaccttctgggagtgatgggttgtgctggaagaatttgaagatagtatcttatgctccggataaagaaatgcattgatgaaggcccttcactattagatttatttttctgtgtcccaactattatataaattcccctatcaaggaattttcaatgttttctccttgcccttagatacgtgatcttataccccaggtttgctgagacattccttttacagatagttctactggctcatgagtgtaatgtgtctaaatgtatggttggacaaatacggttattagatctaaattttaagttcaaatttccttagcctgaagtttagagtcttccacagtctagtcccaaccactttttccaaccttaattaccattgcactttaccctgtatttcaattcatttgaaatatttgctcttttctaaattactctcgcttacccaccactatctctttgttcatactgttctcttcaactaagattaattaatcaacatgtatttattgtccccttcccatgggccaagccctgtgcttagaactgtatgttaggggacaaaacgcacatggtttctgtcttcctagagtttgaatttagtagaagagcaacagacaatacacaggtcaatggacagttcatgcttacaaatcatgtgacagtgtcaaaagtaaacaaagaaggttccctgatagagaattacaggaaggtttattttagatagagctatcaggaaagaaatggcatttcagcctgaacttgaatgataaagggaatgtagttactaaggacttaagtccttcagataccaattccatcatcttcaagatattgccatgatcttcacaaagtttttcctgactcatcattggactctcaaccgtttttagccctgtgctatctgcgtcttgtatattacagaaagtgtttaaggtcacactataaactaaatgtgtttgtctccaatcagactgtaagattgtggaatgttagatccatgtgtgatgtatgtctttgtctcttatcagactatatgattttggaagtttagagctatgtctgtatccgctataacatttatctctgtatctgcatgatacttaggataatagtatgtgggcacatccaacaaatatttgttgaatgaataaacagtattccactctctgcaagtttggcctttctgacatttgtctgaattatagaaggagaaggaggctttatataatagttgaaaattactgttcacgtaatacagagttctgaacttcaaccagaagcaagtctacagcagatgaaaacatttcaaatgagggaattagctgtatataactttaggatagggttgtataagtttagcatttatttgaaaatccattattatatgcataattaagttttaggaagaaaatctggctgaatagtaaatcagttactattttcaaacagttcttcagtagttagttaccactggcttctagaatttaactggtgtttttttttcagtatatcacactagcatgtgggttgagacacaacctcacattacaaatgggtagtcccttgacttgtagatcaatcagtaataatacaactactgattttttacagtttgtataattatttgtcatttctttcccttattatctgtattctcagaaacaaagagtagaaacaaagagaaaggacatgatgtatttttgataggctaccatctcaaattttcattccaatgtttatttggagaaacacttttatctaaaatggaccttttcatttgacaatggcacttgctctcaaaatgagaattgcgccttccaggagagttttccatctgactccaaagccttgaccctcacaaacagtgttgtttgtaatggcccctggttagaaactctcagcctaacaagcatgcagcatagcccctgaagtctcccgtcctatctgcataaatttgggatatagcactcctgcacatcaagcctcacttactcataaaatgccgggaatcattccaaattgctcttccagaggagagtttgtttttaaaattatttcagatagagatgtttcaaagtctacataaatgcataatatttttttctgattgtgctttcttggtgtttctcttgctgtaatacctacttcgccattcttcagggagcacttcaaggacttttgtaatccatatagccttcctaagctgttctaactttcagcaatcccaaccacatcactgacctagtttgtaatgactcaccagacaatgtgttgggttctctagtaatactttgttaagtccaagttatcctttctgctgttgtttctcagtgtgtgtttctatctgagctctccagttaaactgtaatctacttaagcactgggctttgtcttatactctacttctcacaactcttgcctcttaaattggttaatgtatgtttgatgactaattgtacacataatagctacttaataaatgttcttaagaaaaggacaaattaagtattttccctggtaaccctctataccaggcatcactgtggaaagatgcagagttgagaagacagcatttcaaaaactggaaaaatcacttgtaaattatttcagggattcgactttgacattatgttgacataaaaagagccttaaaaacagctattagaaaatagacaaaagtagaaacaaataaatgaatgagtgaatgacatatctaaatgccatgaaatgtgaaaatgatacaaaatgttaagctaatccttttttcttctctaattaatctccactgggtatggggaatagggaagaactggggtattcgcaacaggcaaacattcctgattcttgccctactaaagatagggacattaggagaaaggatcatctagttggaaaataaactggcattgctaagtctaaatgattgagtcaagtgcaaattttataggccaaatagaattttcacaagtccattgactgttgaaaactacttgtaccctggctcaaaggacattttcttgctgtctatagtaagcggtctgtaaactgtgtttgggaccagaaccaaatgctagcctttcatttctcaaattatagcttagtaatcccagctcaaaagtccctgcatacacaatttagtaaaattagcagcataaatttagaaccagaacgtaactatgctttgttccctccagaagtaaaatgtgaaatttcttcccattggaagtctatttatcacttaatttcagatgttgtgatactgttttcatccaatgttagagaacagaaagaaaccttttttaaaagcataactttcattattcatctaagtttttttcagggtccatgagaaatgctaagattatgccttgtgtttgagaaatagaaaaggaaaaagggaggaaaaccacctagagaagtgcttctcaaacttcaaggcacacgtgaatcacctggggaccttgcagattctgattctgaaggtcagaggtggggcctaacatcctgcatttctaaggagcttccagggcatgctgatgctgctggcccacagaccatactactttgaatagcaagctttatcggccatagaggactttttttttctttttttttttttttttttttttttttttttttttttttttgcatggaacacagattactgctctactctaggttacaattccaaggaaataatgactgaaggaaaatactgctatttcaacacttctgagtcatttagttagaatggaaggttaacattagcaatttaatgtggtgggagtatttattgatgtactaatttgcactttgttcctgccaaagctttttactctgttggctccagggagtttgaaagcctaggacagaattgtacttcctaggtttgtttacctattgtggcaaagaagtgagcatctttggagttaaggagagttaagacccaaggagaagaaaaagaaaaactatgaaggctttttaaaatgtgtatccctgtgtaagatctccaaggaccttcccttgacccagtagtagcaaacggaccacagtgatggctgaaattgagtatctcactaacttggtaaaagttgggcaggctcacagtcagacttaaatcattttagagaagtacaataatgtggcattccttgcaccctgatgatatgcaaaaaatacatacctgcttctgacggaatttaaacatggactgttagcaagaatgtacccttaaagttttgtaaactctacagcaaaggaaaaaaaactgctacagaaaaaataaggatttttttttctagctttaccagtaacctataccttcatttcttcatgttactaattacagaaacttttagcagaaatgtatcactcttgggcatcagctagttctaaacattttagctcttaggagcctctggtgacaactgttctgttgttagttttgctctctgactagattgtaacttctaagctcaggaatcctgtcttcaactagttctctttagtactaacctaaccaagagctaggcatttaggaaatgctcactataaatgtattgacaaatgattatgtgtaattagctcttcatcacaatatttttcatcatcaagaaatagatttaagggagatattttcaaacagtatgtatatatcatccccttacctttatgtatgtgtctgtttgtgaagtcagcacatattatgtgctaaactcaagaaactcaagaaacaagggaggttactttctaagcctgcatcatagcagtagaaatttggaagaaaaaaaaaaaaacccatacaattaactgagttataattaaagaaaattatatgactaccaattgtaatatttctaaaatatacccacatatgccaatctattgtaagaaaatgttcgcagagggaaaacaatgtaaattcctagaagctttagatagattctaatgattggaaataagtattacaaatagtccacattttaatgtgacttctagaatgttttggaggtcatagtatccactcacgctcttatgctgcttgcttacaacatacacttggttcccatttttctcttaggaaagatcatactaatgatctgtgatcatatttaccacttggggatcttgctggccatgataaggaatttggactttactctgattacgtgggaagccactagagaattttagccagtaaggtagcatgatctttatgccttaaaaaggttaattgttttggtggatagttgttttagtagttaattgaaggaaggtaaaagtggaagtaggaagaacagttaggaatctatttgattgttcaggaaaaaggtgctgggcgcatgggctataataacaaaggagatggagagaagtaaatggattgagatggaactgaaagaacttgttgatggttaaatacgaaaattaattcaagatggattagagacttaaatgttagacctaaaaccataaaaaccctagaagaaaacctagggaataccattcaggacataggcgaggacttcatgtctaaaacaccaaaagcaacggcaacaaaagccatagttgacaaatgggaactacttaaattaaagagcttctgcacagcaaaagaaactaccatcagagtgaacaggcaacctacagaatgggagaaaattgttgcaatctactcatcagacaaagggctaatatccagaacctacaaagaactgaaacaaatttatgagaaaaaaacaaacaaccctatcaaaaagtgggcaaaggatatgaatagacagttctcaaaagaagacatgcatacagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacgcttttacactgttggtgggattgtaaactggttcacccattgtggaaaacagtatagcgattcctcaaggatctagaactagaaataccatttgacccagccatcccattactggggatatatccaaaggattataaatcatgctgctataaagacacatgcacaggtatgtttattgcagcactattcacaatagcaaagacttggaatcaacccaaatgtccatcagtgacagactagattaagaaaatgtggcacatatacaccatggaatactatgtagccataaaaaaggatgagttcgtgtcctttgtagggacatggatgcagctggaaaccatcattctcagcaaactatcacaagaacagaaaaccaaacactgcatgttctcactcataggtgggaactgaacaatgagatcacctggactcgggaaagggaacatcacacaccagggcctattatgaggaggggggaggggggaaggatggcactgggagttatacctgatgtaaatgacgagttgatgggtgctgacgagttgatgggtgcagcacaccaacatggcacaagtatacatatgtaacaaacctgcacgttgtgcatatgtaccctagaacttaaagaataaaaaaaaaatttaaaaaaaaatgagttggaggaagttagagaaagtgaagtgacaaagatgactcagaagtgtttggcttaagtatctgagtggatggtgaaacaattttcagggataaagaagaatttagaaagaatagtttttttcagacattagtcaagagttctgtgttaggattgagatgcctattggataccaactgaagatgctgaagaggctgattagagtctgaagttcaatgaagaggctcagactgaagatagaaatttggaaccatcaacgtgtagatgatatttaaagccatgagacttgatgagatgccctttgcaagagaaaaaaaaaaaaagctacaatattggagggaagagttttgtgacaggacaatatttatgggttaggcagaggaggagaagcagtaaaggagaccaagaaagaacactcagtgagctagaagtgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggcagttcattttacacacacacacacacacacacatacaccaacacagcatttgctacagatcctaaacttgaagccctggatcttccttacatcatttacccagaggtatctttgtcaacctttttaacttatacccaccagaaagtagaacaaggcagaagttgtgtaggagttctgtccctcccccctcacctcctggcctcagcacaataaatactgtgttgagaacttggctaactgcttcttttcccacattcgatcagggaatacttaaagccatacagtgtccctgttcttccaaaaagcatatggggcaggttgccccttcaggctgacacaaagacacactgtgcaagacatctatggccagtggagtggccgtgtatgttttatcaatgaggcttttgacttgtttctttatgtcgtattgtcatcacgttaaatagaattcaaacaaggaaacgaaatttatattctagacttttaaggcattgcctgccttatagctatgaaactttttttttcatacctggtataattttccaccttaaacgatgttgtgtgatttgattatggttttgactctcatttaattgttcattttaaaatttttaactgaagttagatttagatttaaagttcagtgcccataaaggatacttctcaatagagccaagaacttcagaaggcacaacacaaaaagggcaaagttcaaaacactaagcatcaggtaggtactttattgtccagggacttgtctaggtagactgtcaccttatccatcttcattcgctttctagtagagcttccatcttctactgcaaaatagtttctggaaccacttccatgttgaccaaaagagagtgtcaacaattcctttccaaaattgccctttagaaagtgaatctaaaatgtttgattcaagtatgtgagggtagctacatcaaagttttcttttttactatgtacaaaagtgacagataaatccatgaaatatgtgcatttttctgctaagactgcttattaatttaaaaagaggttgttagaataaaaggtcagagagtcaacatattacaaatatttattgagagcctgctgtgtgcagagttggaaaagataaaatgaggttgctactttcaacagacttacaatctaattgagggagcaacaacataaacatgcaaagcaaataatgcaagatacagcataagacataattaactatcagatgagtgacatatataataaataccattaattcaccagcaatcataatcagaagcactatgtgccaagcattctgctcagtacttcacatacattatatcattttttgaaatattatttctactttatagatggaaattgcctctgatcttccctcctttctggagaaagcaaggagaatggtataaggtagacaaagacctaagcagatatgttggtctggggcaaagggtccgtttaggggaatggagagaaatgaaccctgggaccagcattagtctgtttaccaccgtatcccagggcctagtattgtgccttgcacataataggtgctcaataatatgtcttaaaaaacaaatggccctctggtctgtgcctgtaacccagaccaagtaccatggaataaagttaattagtgaattaaagccacataccacatagcctaaggacccatccccaagacctcccaattcccaactatgacggtaaaggatcgcagtggaaaagatacatcatagggggatagcaatagcaattccagcttactggggcctattttatggaatctgacatggtgaacagttcataagtttatttccaggcttcaagaccctgcaacatctggcctcttgcacctccacaacctcaaatccttctattcttccctcactcgctctactcctgccacacacacctcctttctactcctcaaatccatttcagggcctatattcttgcttcattttgcctggaatgttcttccacaaaacatctgtgtggctcattaccataccttcagatctgtaagagccactctccccacatcttcccagctgcctggcattatagtacacgtctatttgcttatgtgtttgtccccgtacacactggaacatgggtccagcgaggcagaattccatctgctatttttaccattgaatctccagcacataggacagacatagcacattgtaagtactcacacacagcaactcttaactcaggattactttttctggctctgaaatacctacttccaagagaacgaaatttattcaagaaatgttggatggaaattgaagagtgagcttggaaacggcagacagagtggcaggagcccagaccaacctgtttatgaaagatgcctttgcccataaagggaaaaatacaccttaaagcctctgccaaagtatatgctttcttaggacacctctgacatgctgaatggcacctggtctgaacaagaagatctatggatttgccaaaacaactaattcctgggacttaagaataactactaccagtatcatcctagtaaacaagtagcaagcaacaagcaccacatgcaaaatcattcaaatgccttcatgcaggtgacagtcagtggaagaaattaatcttatttttattattttttcccttatcaaacactagcaagggaccagatgtcataaacctagttaaaatatgttgactttacctcaaatttgagtattcatggttccaaaaggacacttgttataggatctgatgatgtactttaaaatcttcttttgtgcaaactgaggattcagagaccacaaaatgtatggtaaattcaaagtactattataagtaaaatcataatgcctcacgacatttttgaaagtaaaatatttaggaatattacaaatatgtattgagcactccctatatttaaggaactgtgctaatgctgtgatggatcaaaaggagaatgagccatgatccttaccttcagacttcaagcttattattcattgggcagttagataactaacatatcagacaaggaataataagtgccattgtccagatattaaaaacaaaattggtgttgtggaagcacaaagaatgcagagatggatcccaactgggagaaagaaaaagtgcttcctaaagaagacgctcagattgaccttgaaagttggatgcttttgcacaggattagaaggtaggaagtcttcatttgttggacttgccaattattttggtgtaaatattcccactgtggctgatttaaagttgataacgtgatgcaactgaacacagaattgggaagagaaggtggctctagcacactacctatgagtcaccatctgagctccaggcttaattaaatcagcctcctcactactattttgaatgagtgaaatcacaaatcttaaaaacatctatgctaacattatcagagaagagatagtcacttctatcattctccattacaactccatctaactttctaatattctctttgaatatccttccaatctcagtctcagtcatatgttcctggctggcctacctagaattaatcttggcacagtgccaaactgtgattctgtttgttccttttagcattgctgtgattaatctgcactcctgttatcacatggcatagaaaactctcttactgattatggcctggtgttgacacctctgctgttctccgtaatgaaaagcagctttcagggtggctagctgggcaggatgtttcgctgctcttgtaacagtaggaaggaaaaactggaggaattactgggaagctttgcagaaggaagatacaggccagccgagagccagcattcctattacctgctcctttcagtattctttgtgaaaacaccaccaccagtgtgttccctggacgtcactactgcacctttaactggccttattatgctagggactacattagaaaagccagactctagtatctgtctgtaattgcaagcggatgtctcagcacatgcacaagcttatgtcaggaggatgtttatgaaaaactcacaaagcagagcactgctagacaggaaataaatatgtgaagcttgaagttgttaggaaacttccacatttgtctctctaagccagagataggacctgtgagaaaagaaggtctttatcattgcacattgattctcgttaccttgaagacttgcttttctcaaaatacatttacagcaaaatgtggccgctgcagatttatttaaacatgtgcttttttctatgacactggtttctcttccaaatttgttatctattattttactgtaaagcattaaaaagtgtttgaaaccaccagcaccatttcacagttcctgtgttatttgtttaaattctctagctcatgtaatatgccgtatgatttactgtttaagtatagaagaaatacactccctcatggagatgtggagatgtggagaggtaatactgtctcctggaaaggctcagagatttcctgtttagattacacaggcttctttagagctgccaagagtcataacatgtacgagataatacactttggttcaggagaaactatggatgggaatgtaattaattcactgagccacaaaagaaaggaaattccagcgtagagctgtcactgcactcaggcccggtggacttggtatgccaaggggtagccatgatcaaaaagaggattgcagcctgaggacccactgagtagtatccaaccacagagcaaaaggtgggggcctggctgctaagggtctcacctggttctttgagaattgatccctgaagcgtatttctgctcaacacttcagcaacctggcttcatcagtataactttccagaatgcttgtgacattgagataaatcaatcagcatgtactttatcaaatgcctcctcatgagtaccaactgtggcacatagtggggaagccctagaggaagaacgctgaagaggatatggtgattctgatcagcgcaagaaggtatagtgaaaagtgtcctgaactgtgtcttgtcataagaatcgcctgtcagggaggggtgtggaagggcaaggtaagcatacatattctcaggacctttccaaaatgtagagtgaccagggacctagagattcagactctgtcgatctggaccaaagacctagacttggtatatttaataaatgctgtgtgaggccctttacatgcattacctcctgtaattgtatagaacagttgctgtatatggtactatgtttacttgtatttgcactgtctattcagggatgtttcaaaatgccattgctatccaactggtgaattattattcttgccagaacattgattctcctactcttgctcccttaataatacactagagaactgggattgactgcatttagtctcaggctgaatgaatcattgccataagtagatttccatcccctactccaccgatacatttgccaaacactcttaaagaatagaaaccactgcctacatacagcctgcaccgggaggacctaaatagtctagctgggtttatgacaatatcccatcttcacatcagcaaaaccctaagtgcacaaagtctaatgtaaacacattagactccataggcatcttctccataggaaaagacatgccccggctgtcaaggtagtggctagcaataataacaatgacaaaaacaataacaatgataaacatgtataacatttacttatcactaattgtattgtaaatgaaatgattagcatatactaactgatttaaatcttatatatgtatagatacttttactctcccaattttaaacacagagaaaccaaggcccagatacgtgtttctgttgggaagttgagtacaaagttgggtgtaagtagggaaagttcaactgcagtcggttctagtcttggtaagtccactgtgaggtgctccacctcaaagcatagcaaattagtagttccccatgtttgcagaatcaaaattaagttctttggcaaggttctccctgatgtgcccctgcttcttccctaactcaacacatcctcagctccatctatgcactcccaacacatcacaactctttatatgcccaggctgtgtcttctgtacctttgtaccttctgcacctttgtttctttagcctcaactgccctttcttttcctctacattaccctttatcccaaatttagcacctgtctcaaggagtcaccttccccaggaagtttgtccaaatttgttaacagatattccattgttcctccaatgcttgatccttctttctttatagatccctgcctagaaaactggactcactgaggccaggggctgcaggtagtttattttataacccagcatttaaaagtgcctatttattgatttgttgggaatagttaataaatggagtccttgcagatcataaccaagagcacagtttgtaatggtttcattaattttgttactattggatgtgattctctgcttatggtcttcctttacttgtttttcccttactgctcagcacctgtagatattaggtacatggctctgacactaattaaaattgatgactgagaatgacacttccatttgctaagccagcgcaattttgttcattgtgctttactttttaacgagcaccctctcagcagtagcataaatctatagtctttccatgagggtaccatttgttccttttatgtcttgattcattacatattttcaggagtgtgagctgattaagagtttttggtttgtgaaaatgtcaccaaatgcacgataaaggcaaagtcaccagatgtctgcttgcaaaaaaattaaatgctggtttgtgaagatccaaggctggccagggctccccaagcatttccaggcctgagctctggctctacactctccttagggtctcataactgacccccacattccatttctgccatcatggaaaaattcgtcaactttactgctgatgttaggcctggaaattgtcgtccattcgttttctcagattcaagctgaaaatggagacaaacttcctacgtaattttgaccaaaataacacatatgtttatgtgctatcccataattaacatacttttaaaatcactttcttgaggtatagttggcgtacaaaaatatgtgcatatttaatgtatacagcttcattaatttggagataagtatacatccatgaaattataactgcatgtatgccataaacctattacctacaaaagtttcctttcactttctttgttattattttgattaacttaatttttttcagccttcgaactatcaaaattttctcaagtaatacatagttgtcagttatacaaacttactgaaccttgatcgaaggtcctcctttagtgctcaacttagagaaagaaataatgaaacaaagtgttctctgatttgtagcaaagatctgtgatggtgatgggaatggttctagaaaataatgataataataaagacttagagtatcaaagcagcaagtatgtttgaaggaattgttacaatgcagttttgctttctggtcactttaaaatcaaggtgtagtactttatttactctaggaaaatgtttgctttttgtcataatttcttattgcatatgagagtaaatgatctatagatgaagatattagtaaaatttagagagagaataaaaaagaaacactttcacagctgaaaggctgcttcccagttagctaactgggaggagttaatgaaaaagtacattaaaaagcggctcggggaaggtgaattggactcaccgggctctgacattcagagagatgggaatgagtcagctcactgtccagtacatctttattttctttctctttcttgttttatatcagaaatagatttcttggcattgttactgtgggtttctattaaggactgaaacaaaagtattaataatctgagagtatgtagaaaacaaaataaattcactttctcccactatactctcacaacacagaatattttagtgaccagagatcaccaaaatgtgtgtggtgttgaccaaaagagtcaaactctgtaaaatatttgaaaagatttattctgagccaaatgtcagtgaccatggcccatgacacagccctcagggggtcctaagaacaggtgcccaaggtggtcagggcacagcttggttttatatattttagggaggcataagacatcaattaaatacatttaagaaatacattggtttggttcagaaaggcaggacaactcaaacagggggcttccaggctataggtaaatttaaacattttctggttgacaattagttgagtttgtctgaagacctgggattaatggaaaggaccattcaggttaatatatgtttcttattggacctaaaacagtgcctggctcttagttgattattgcctggatctgggaaggaaggaaggaaaacaaagggggaaggagatttgctatagaatgtggatttttcccataaaagactttgtagggccatttcaaggcatgacaaggaaatatattttggggttaaatatttttttccttgtctcataatgttataccagagtcagattgaaaatcaagtcacaatatacagggtcaaataaaacccatctaatgagaacccttggtttgtaggtcatgactcccttgggtaggaatttgggcaagataaaagattgaaacttagtcctgggtgggaatctctctccacacaaattctccaacaggttcttcaacgggacgccaattgggtgttctctaattcaattcaattctgacagtctatctatctacctggaaatagcatcagataccacaggtttagggctcagtccaacaatactgcccgtcacttcagatgccaattgcaagtaataggttgttacctatacttctggccaattagctgtaagttggggttcccacaacctcctcctcaggtttggtaatttgggacagcttgcttacatttaccagcttattagaaaggatattacaaaggacacagatgaagagatggataggataagatatgggacttggagttgcagagtttccatgacctctctgagtgcagcatcttcccatgttcagctatccagaatctctcacattaagacattggccactggtgatcaaattaaccttcagtccctctccccttcccagaggttggagagtggggctgaactgtctcaacctctaatcaactcttggtctttcctgtgaccatcccccatcctgaggctctccaggagcccccaggcgtcagacaactcattagcatacgaaaaacacttatcactccagagatgccaaggattttaggaactgtcaagaaacagaaacaaggtcaaataggtatttcacaatatcaccagtagtttcactgggaggtaaaactcaatgtttactgtgagcctgagctcacagtaaagttatctaagttatcacagtaaagttatctaagaataacttagaggtaacgtgatcagatatggggaattctggagaaacacctttcactaccaaacccagacaagagatgcgtacttttctagctgggatgcttacaaagcaacccattgtaatacttaaaggtagagtgacactacattcatcatttttcattttttcctgttttttatgccgcctactactaatgtcaatcaaattatgactgtgtttatactgatcatctcacatcataaacttgatcatctcacatcataaacttctgtgtctctcatgttgagcttttcacctcccttcattccctccctacttccaggatcattcacatgttgatttctaaaaaaaactttttttactgaacttattttcatactgtttaaaaagaatttatatttctcctcattcttacaaataagattcaagtttaaactcaaataatgtaggaaatcattttttttaaaattgttccctactgtgtctaggcttgagaccacaggtaattaagaccaggttttcatttgatatgatttttatgagttctttttagaggttaggtaggttaggcacaatttttatttttaaaaagcgggttattatgagaggagaaatcatactttgtcatttgaaaatgatgccataagaggtgttagcagaaaaatcaaactgtaaaatattttagagatttattctgggccattataagtgactgtggccccactgaaatgagtgagttccctgatcctctcacagagcatgcgacaggggtctggctcacctgttcagttgccccactgctcaaacccctagggggagaatacagacagtcaggtgcagaggctggggcaagtgctttggccccttagccctgcagtagtgtctaggggtggggtgcccgcaaccccagtgttacaaagttctttcagctttgcagtccacagacagctggagtgttaatcagctcaatggaccctctgccttatagcaagggcagaaggccagagtgacagctttctgtattccaagctcttgcccagtgtcctagaaaaataagatcatacagggctcgaaggacgagtgcagggttttactgagtagtggaggtggctctcagcaagatggatggggagtgggaaatggggatggattgggaaggtgaacttcctctgaagtccagccacccagtggctggactcttcaacctcccccagccaagctcctctcagcgcccagatggtcctcttctctctctctctctctctctgccacatcatttcaccatctgtctgctggtcagctggcttgctggtgtgctggtctgttggtctgctggtctgcttctggaacctgggcttcagagtttatatgggtgcaggatagggggtgttttgggccaaaaggcagctttttggacatgaaaacggaaatgcctgttccatttagggttgcaggtcttcaggcttgagggtgggacctttgcgcaggaactaccctcttctacccagtgtttccctgtctcctgtccatatcaccagtatacacagtctcaaggagtcctgagaaagtgtgcccaaggccgtcagattcagtttggttctgcatgtttcagggaggcaggagttacaggcaaaaacataaatcagtacatggaaggtatacattggttcagcctgaaaaggcaggatatcttcaagtggggacttgcagggcatagtttggttcagagattctttaatctgcagttggttaaaggaacaaaactttgtacaaaagcttagagttagcaaaaagaaatatttaaattaagataaggatgctatgtcagagtcagccacaaaatgacctgtttagcaagattaatggcctacaggtgtgacttaacccttgccttgcatggcctaaggtcttgtttataatttagtatcttattgcccaaagagtctattttgtcggtcttatgatctctattttaacattaatgctggtcacttgtgactaaactccaaaggggaggcatatctgacttgccttcccattgtggccaggaacccaagttttcaagtttctctggagtccccttggccaagaaggggtccattcagttggtttggggagctgaggattttatttttagtttatacagggtcgtatgagattgttaggacaggaatgactaatgttttcttctctttctgtttcagccacagcagctatccttagcagagcatcctggagtctgcaaagtgttaatccaggcctaaagacaagtaagaatttcagttctttttcttccttcaatgatattttccatgttttagtgtaattaagctactatccttctctgttttatttgggatgttagtaactggaatagtgactgagatgaaattttataggcaagcaaaacattttttaaggatttgtttcttaacttctgatatagtttggatgtctgtcccttccaaatctcatgtcatccccaatgttggaggtggagcctaggaggagatgtttgggttatgtgggcagattcctcatgaatggtttagcaccctcttctttgtgctgtcctcaccatagtgagtgagttctcatgagatctggttgtttaaaagtgtgtggcaccccctcttcaatctcttgctcccactcttgccctatgagagacctgttccacttcaccatgattataggcttcccgaggctttcaccagaagcagatgctaatacagcctgcagaactgtgagccgttgaaatcatttttctttataaatcacccagcctcaggtacttttttatagcaatgaaaacaaactaatacaacttctctgcaaggctgctttttctatttttgcttatgcttagaggttaagtaaggccaaattaatgaaggaggaaaaaagaggaaatgatacatcatggatcaacaattatttattgaatttaggaaactgcctctttttacaaattctttttaaaattattatcattattatcttgaagtatttatctaaggattacattgatagaaagttaaacttgtctctccaaccagattgccttaagcttcagaattatgccttcttgtaagctccttcttactcttaaaatgactttacacattcccccctggtcctttgacaatctcctcttcagtcacaggacagaaccccaacatcaactctgtggggaagcttctccaaattctctaggcctgaacaattttctgccttctctgcttccgtggaactttgtcctttactacatgatagcgtttacctcctgacattttagtgtgtttgttagccctgcatatagaactcaccagattgtgtggactgcatgaatgaattaattctattgaactttaaggcaaagcctaaattttatgcttcttctaaatcccttacatctcctaaaaaaaattctgatccatagtagtaggtacttgtttaattaaattttagggatggatgtttttcatcagtggaagtatatgctagagtccatattatgcaataagggaagggaagacagagtacctaattcagttaagatattgctattcttgttagtaattctggagtcatgaaatcataatttgaattttatgactaaattgcagaataaatttccaatgtgagatttaaacattatttccttggaggtgaccaaaaaggagagttggtactgtttttaagaactgtcattcaattgtcagttgtgccagagcacaaatcctttatagccctcctgtttaagaagcatctgacatgctaagctgcttcctaattaacacaaaggttgtaaaagaagtggctgtttggttgtgtttgggttatcccagccagtatattccaaagcttccttcattcaacagatgagtgatctcctttatattctgtaaggaaatgagaagtaatcagttaaacatgcattactaatgctacatgcttcacattgaaaccatcctcctgacacataatactttaccctctgctgtcccccaaagtggcagtaggatttctgttaagtcattttctttattaggtcacaaggtctaagaagcctaaacattgtgccttgttgaaatataacctctaggtatggaggatgtgttgaacaacttcctaccagtcatttggcatatgttgatttcctgtcttcatgatacataagacaactagctaattatcattcatatgtggtaaatcacatagatactgacttcccctatctttccagctttttcttatcaaaagttacctgctttctgtcgcaggaatgattggctaaagtaacctatatcagggtctgtaacagtgggcacctatcagagtgcacatgcttgaacatatcatcgcctttatcatcataagcctcacatccagatgtgatagacccaagtgctcacatcccctcactctgtcactgtatatgttgttaccatatcacaaatatttaacaatctgctgtgtactcaacctttagctgtatgccctgagggagacagagtaagatactgccctgacatcaaggagctcacatgctccctaaagagataatttcacatgaaaagttagtgtttaacatgaaatgtcctgagaatatacaattgtaatttgcatgtttcctatgtgtacttttctaagttctcagattcaaaacaaaaccccatggaagaaaaaatgaaataaaaaccctgtcaggacaaatcctagccagaactgaccaaacataaaaaataaatgccactgccctctccaagccacctttactttatacttgggtctaagaagcccaaacattgtgccttgttgaaatataacctctaggtatggaggatgtgtcgaacaacttcctaccagtcagtgaagtgcagtgaccatttagcagtatctccttcctctctctttccacccgctgccccatctctccttccttgcatctatcttctcctgccaacaataattttcttatgttctaagtaaatatctttaatgctgtccctactacctaaacattaaacttcaaacctttcccaagaccctgaacacccaccccagcttgtaagttcaggctacttacctgggaatcccagacacactgtatattccctcctctggtacactgctcatgtcatcgaatctatcttcctcccaccccgccgtggattctgtaaatatatatcagtcctacccacctttaagtttcagtcaaaacctgatacttacggcctgaagcaatccctctgttctccatgctagtctatgagagaggtcatgatatttcagtagctctggagagacacatatggtcaaaccagaccagctcaaattaacccatgctatgcaccacctaaagaatcacctcttgctgtaacctctttcttcaccaaaaattatctgtcccatttgctaagtaagcccttagggctttgctgtgcctgcaacaggtcttaatccatgtgaatgtgcatttttgtgttagtgagcacatgctaacatgccttccacagattagtttctttagaaacattttctggggaaaaaaaagatatatttttggttagtaaccccaaaaggacctttcagttcacgtacgtgggtagcagcatactccacttacgcaaaggtcagcccagggtaaatatgagcaaaaacacatacttaggataagaagaatgttgagggagtttacagtttaaagagatatccagacaactttttatattttaaagaagtaatgctataattttactacaaagaaaacttctttttgtttctggggagaagaatgagaagagttacaatctcctagagaaaagcaaaacatttttagtactcccaaataagacaggcacctcagctagggtgctgtagttgcacgttctttgtgttttttcaagaattttatttctctgtcatgattatttattggcagaggatttgatgagcatttgggccaaatttataagactttcaacacatatggagaaaaaaaattagatgattgcacatctttctgagggagatttttcccctgttttaaaagtcattgcttttcactgaatttatcatgtattcctataaaagtgtaaattttgtgattgatagcatttttacctcaaaataaaatgaatatccaacaggagcaagttttattgactgcctgttggagcgtaaattagtctaaggtttcatgaaataggcatttgaacatgaatattaatggctgagatcagaggcaacttttgaaaggattccaaaatattatcatattagattggcacagcaaatgaattgcttgaatgctagaagttcacaaacattcaaacaattgtgagttacattaacttcaataaaaacttttgcaggacaaaaatttaatgtagtaaacttcatcttgcttgtccaggtccatatacattcttagctggactcttgtcctagcttcctaatttttcttcctacctcctatttttccctattccaagccaccatacttgctcttgattaattcttcctgcctatctctgatttagtgattcatctgcccagtcatctatagtagctccaaactgttctctaaattatgaataaacttatctccctgacattcagaaaattctacagcattcatcttacacacttttctagccttatctcccttttctcctttgtactcctatgtttatattccctgcattcttgcttcattgtatccatttacattggcccttttaccagtaatttcctcttctttcccctcagtctgaaacagtccttcatagattttgtcctataagccatatttcaaatataactttatccacaaagctttgcccagttacctcaagagaatgcatgcttctgctttagaattgtagcctttttttcctctctcgcaaggagagagtgtagcaccatggttgaagtactcagcctctggagtgagctttagtttaagacccagttctactgcttacttgctatatgatcttatctaaatttgataacctctgtgtcttttttttttttcaaaataaagatgctaatagtacctacctcataagattgttgtgagaattataagtgttgatacatttaaagtagttagaatagtatctggccctatagtaagcttacgtggtatttattgtattctctcatggctcatattttattccaatgtgtattaaattgaactgtatgaaattgcccatgtcaactctatattggaccctaaaatcattatgtcatgtggttcaaccaaatgtagtgctttttgtacccccaccttaatatactgaactatctcgaaagataaggactatatcttatacattgttgtgtcctatggtacctgctgtgtacctaacacatgctgagtattttatggatggttattgaattttgcaaatgacacacacacacacacacacacacacacacacacaaaatgcannnnnnnnnnnnnnnnnnnncacacacacaaaatgcaaaaaacaaatagaagccaagaccttcccagtatcttaagtactctttggctaccacagagtttcctccatgtggttcagcagtcatttatgaaaggagagtgataaagatatacaggaggagaattttatcttgtctattgctgagtataaatactatgcctttcccaaaagccttccacagaacctttccttcaggtcagggacctagtgtcatgggtcggtcttggataacattgcaggacatatcagttcaactgccaagggaatcataaatagtcctactcctgcctgtggcccaccactgcctccatagaaggtacatgaccctctctgctttcattcttttttatcagatattttcaacatcaagaacttattagctgataatgcaactaaattaagtataacataagggaaatgtgtcctggcagggatggtatcttagagtgaatgtacagcctttatttgttacaaaaaaaaaaaaaaaaaaaaaaaaaaaaaaaaacttgagctttggacaagcaatagggagcagcattgatactgggttctgacatggaagctgacattaaattcttgacagtctgcttgtttataaactattcagtaaacaatttagtaagtaaacatagattcttgctatctcttttaaggaaagagtggttatggtggctttctcttgtacccaacctagtgctcagcctttcctgactcacataagcactaatctccagataacaccaaatgtcctagggttattatttatcccccttccttgttctctgaaataagaggaaggcaggtaaaattatgcactttatgtaagaagaaatagaggtacagagaaaacagcttaagtctcttaacagcccaagagagtgaagaagatattgccagtgcagtgagttgtatctgtccctaggtaagcaaaatattaataaaagcatacaactatgttaataattcaaacagtctttacttatatggactttgcagtgacttttttccagcctgaaatactcagataatgactgccattagtttcacacgttagtgctttattatatactgctttgctttcacacgaaattgttgggagataagaattttatgtaagataaatattgggtcttaacttttttataccccttcaacttcaagcaattttctgagcaatggtaagtggtaaatagatatttaccacttaagtttacaagagacctgtttctctctgttcattggcttaggcactattaatgaaacctttggaatgcaggtcccttctggttgtaaacatatatcgaggtcttctatttcttttggaactcaaacaataagaaaataattagaaatctgtgggcataggtctctagaagccttaatcttagaagtgagtaaaacaaatttttaggccaggctcggtggctcacgcctgtaatcccagcactttgggagaccgaggcgggcggatcacgaggtcaggagatcgagaccatcctggctaacacggtgaaaccccgtctctacttactaaaaattaaaaaaattacctgggcgtggtgacgggcacctgtagtcccagctactcgggaggctgaggcaggagaatggcgtgcacctgggaggcggagcttgcagtgagccgagattgtgccactgcactccagcctgggcgacagagcgagattccgcctgaaaaaaaaatattttttttgtaaagcctaggaaggatgattaagcatcttcctaaaattttcagtatgcctgtgtacactgtatatactgacttctagcatggtttctttgccaaagcataacacatagtttttaaagggataattcaagaccaacattctttcactctgggtgaccccaatgggtggtgaacaccttttagtaactcttgaaagttaaagcatccagcagttggttgtgacctttttggttgtgacctttgagttattctagcttgtagcccactgacttgctgctcagttccacagcttcaaaaccagctctaatcactgctcccaagagagccctagcttctgcatacaggaggctctcaccaggaaaggatacctgaagtccagaaagacactctgtccacactggctcctccttgtagggaacagttttttcaaataatgtacatttatgcactgggaaaatatcttgaatttattatttaggtgtaaccagactttaatacaacttaacctacacactgggaaagcagactgtacaccacatttacaaaaagatttatggctttaacaacgcattcaagtgtagttactgctaaatagcagttcaagtaattgtgtgtctcatggcaaatatatgcaatgtaaggtaatatatatttaaaccaaaaataacaagaggtgattatttgctaaataaagaacttattacttaggaaaaaatgttatacaactttcaaaggacttttaaaaatataatatgatttataggaaatttatttgcgtataattcacaatgtctggtacaaagtaagctacctctgtgttttttttttctttaggtcaacaaatatttaaaccaagggttggcaaactggccctcagaccagatgcttatttttgtaaataaagttttattggaccacagccatgcctgtttatttcagactgtggctactttgaggctacagtggcagagttgagtagctaagacagatcataggtccacaaacctaaaatctttactctctggccctctaaaaaaaaagtatgccaaaccattctaaacagaaaaacaattaattctttttttccaacttttattttagattcagggagtacatgtgcaggtttgttacatgggtcaattgcatgtctctgaggtttggtgtacaaaaaatccccttacccaggtattgagcatattacttgatgtttttcaactgacaccccctcccaatcttccccactctagtagtcctctgtgtctactgttgccatctttatacccatgtttatccagcatttagctcctgcttataagtaagaacatacggtatttggttttctgttcctgcgttaattcacctacaatgatgacttccacatgcatccatgctgctgcaaaggacataattttgttcttttttatggctgcatagcttttcatggcgtatatgtaacaaattttctttatccagtccaccgacaatgcgcatctacgttgattttatgtttttgctattatgaatggtgctgtgatgaatatatgagtcatgcgtcctttttgtagaatgatttatttttctttgggtatatacccagttatgggattgctaggttgaatggtagttctgttttaatttccttgagaaatctccacactgttttccacagtggctgaacgaatttgcattcccacagcagctataatatggttgtttgtttgtttgtttgagacgggtctcgctttgttgtctaggctggagtgcagtggtgcgatctcggctcactgcaacctccgcctcccgggttcaagcaattctcctgcctcagccttttgagtagctgggattacagatatgcaccaccacgcccggcaaatttttttgtatttttagtagagataggggtttcaccgtgttggtcaggctggtcttgaactcctgacctcgtgatctgcccccctcaggctcccaaatataatatggtattttaaggaactaatcatcaagtttgtattggttaccatcttttagtctcctgttatcttcagtttcataattggcattaatgacaatatggtattcactttataaatttgcttcatagtaaactcttctgaaataaattacagtcatgcatcacttaacagtggggatgcattctaagaaatgcataattaggcaatttcatcattgtgtaaacatgaagtgtacttacacaaacctggttggtacagtctgctgcacacctagcctgtatgatatagtctattgttcctaggctacaaacctatacagcatgttactgtactgaatattctcagcaattataacacaatggtaattatttatgtatctaaacatagacaaggtacaataaaaatatggtattgtaatcttatgggacgactatcacatatgcagtctgtcattgaccaaaacatcattatacagcacaagactatagttgaaaattttaaattatatatatgggttgcattgtatttctgtttgccgcattgatatatacatttaatggtttgtatgtttgtacttgcattcatatacattaaactgttacagggagcatatttgcttgtgttaaaaaataaataatatttatttctaatgacttataaaattattatggttatgtttaaagaggcttgaagaggtattatggttatgtttgaagaggcgacagaaacatcacctttgtcattgaccaaaacatcattgtgtggctcatgactgtaatagtgtaaagtaaagattaactgtattggctaatcaatgtggacatatcattcagtattactaaagattctccatccaatgaagcctgaacacctgtaaatgcttggtgatggatggaaagggcaattatttgcagctggactgtctgagacatgtcatcattattgcataatatttatttaacgaaggatcaatgcaccgtacagctccagtttgagggcacacttgacattgtagtttgtagatcttttataaactgactgctatcactgaagttttgctgaagaataaagacaaaagattctctctttaggaaattgtgcactttaaagactcagaaacctgaaacctcacagaatcataatagatgtatttttcagagacaatttctgagtccttggcgtattctcaaatgtcattcatgtcttcactgccgcaggttatctttttatttttatgtgtcatggaaaagcagcctttttctttttttctctcttactatgccttaataaatagaatttaaaaccccaaatctgaattattgtgaaagccaatatttgtagcaaatccatctatgctctgtgttgtcagcacatatggttttgtgcacctgctaccatgaaattctgccagggttatcctcagagaaatggagagacacctgatgccatccttactgtgacagacgtttttctttctgtgaattccaaaaatttttgaagttatgcatctcttgcagtgaacttcagtgacttgtgtacacatggtatcttcctttctagattgtaagttctttgagggcagggactgattctttctcatctttatatgctctgcttctccactcttggtttagccagagccttacacaaagtagaagcttaaataatgtttattagatgaatatcatactgagttccagaaattacctgagagcaattgaagaaggaaagtgtggagggagaggtgttagcatagagttcatagtgtctgagtttggcatccttttcctcaacacgaatactaacacagataagtaacctaactgtcttctcaaatctgagaggagtagatgcattttctcttttaggacttttctatctcatgtgggaaaagcaaacaagaaggtcctacaaaagtcttgtaggtatttattcttatccgacagtggtggatgtgacaaactctcttattggtttcagttggtcccacaggttatgtgatgaggactttggggtttggggagctgggaaccatgagttgtctcttatggatgacctaacatactgctaatacctgacaagcttcaatttatccatctcgaaatggagatactaacatctgtctcaaagggtcattgtgaggagcaagtaggaacatagaaaatttcctagcacaaagtagatatggaagatagggagtaagatgttaggtattttattgcttctactgcttctgctgctgttactactactgctattattattactactcctggaagagtaggacttcctgggacactgaccctacttaccccttcaccttattcaccaaaacttatctcctatataaattcatttatatttttctggaatgataagaaaaatccttcatctaggtagcatattttatatttgaatagtttatgtttcaaataaataaagtttttacaaaccccagagaaggcctatacagccaaatttgaaaaaaaaatttaaaaataaatattcagtgtttcagatgtgtgtgtgtgtatcttttaattgccatgtatttctaccaaaaaatacaaaacttaattttgtatcctgaaagaccctcatttgagaatccctgcttttatgttctgccatgaccactttagtccaggcaacagatagcttaggttgttgctttacaagtggagaaacagggctgagaggctcgccatactccaaattaccagtgccagtcccatggcacaaagacatgaaaggcaggcacccaaacagaaaggtagtgcaattaattgcttcaaagtcttcactcagggctgcccttaggcatgatcagataaaaatgtacacattgcttggcacctggtaaaatgttgtttcctttccttcctccttcccctgatagactcttcttaggtacagaaaagatgaggctgcacacatagctaaaagctatgccattaaaacaaacttcttttttttttttaatttatttattattattatactttaagttgtagggtacatgtgcataacgtgcaggtttgttacatatgtatacttgtgccatgttggtgtgctgcacccatcaactcgtcatttacatcaggtataactcccaatgcaatccctcccccctcccccctccccatgataggccccggtgtgtgatgttccccttcctgagtccaagcgatctcattgttcagttcccacctatgagtgagaacatgcggtgtttggttttctgttcttgtgatagtttgctaagaatgatggtttccagctgcatccatgtccctacaaaagacacaaactcatcctttttgatggctgcatagtattccatggtgtatatgtgccacattttcttaatccaatctgtcactgatggacatttgggttgattccaagtctttgctattgtgaatagtgctgcaataaacatacgtgtgcatgtgtctttatagcagcataatttataatcctttgggtatatacccagtaatgggatggctgggtcatatggtacatctagttctagatccttgaggaatcgccatactgttttccataatgggaatttccataatgggattccataactagtttacaatcccaccaacagtgtaaaagcgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgtatgaatgtcttcttttgagaaatgtctgttcatatcctttgcccactttttgatggggttgtttttttcttgtaaatttgtttgagttctttgtaggttctggatattagccctttgtcagatgagtagattgcaacaattttctcccattctgtaggttgcctgttcactctgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagcagtggtttgtagttctccttgaagaggtcctttacatcccttgtaagttggattcctaggtattttattctctttgaagcaattgtgaatggaagttcattcctgatttggctctctctttgtctgttactggtgtataggaatgcttgtgatttttgcacattaattttgtatcctgagactttgctgaagttgcttatcagcttaaggagattttgggctgagacaatggggttttctaaatagacaatcatgtcatctgcaaacagggacaatttgacttcttcttttcctaactgaatacccttgatttctttctcttgcctaattgccctagccagaacttccaacactatgttgaataggagtggtgagagagggcatccctgtcttgtgccagttttcaaagggaatttttccagtttttgcccattcagtatgatattggctgtgggtttgtcataaatagctcttattattttgaggtacattccatcaatagcgaatttattgagcgtttttagcatgaagggctgttgaattttgtcaaaagccttttctgcatctattgagagaatcatgtggttcttgtctttggttctgtttatatgctggattatgtttattgatttgcgaatgttgaaccagccttgcatcccagggatgaagcccacttgatcatggtggataagctttttgatgtgttgctgaatccggttttccagtattttattgaggatttttgcatcgatgttcatcagggatattggtctaaaattctctttttttgttgtgtctctgccaggctttggtatcaggatgatgttggcctcataaaatgagttagggaggattccctctttttctattgattcgaatagtttcagaaggaatggtaccagctcctccttgtacctctggtagaattcagctgtgaatccatctggtcctggactttttttggttggtaggctattaattattgcctcaatttcagagcctgctattggtctattcagggattcaacttcttcctggtttagtcttggaagagtgtaagtgtccaggaaattatccatttcttctagattttccagtttatttgcatagaggtgtttatagtattctctgacggttgtttgtatttctgtggggtcggtggtgatatcccctttatcatttttaattgcgtcgatttgattcttctctcttttcttctttattagtcttgctagtggtctgtcaattttgttgatcttttcaaaaaaccaactcctggattcattgattttttggagggttttttgtgtctctatctccttcagttctgctctgatcttagttatttcttgccttctgctagctttcgaatgtgtttgctcttgcttctctagttcttttaattgcgatgttagagtgtcaattttagatctttcctgctttctcttgtgggcatttagtgctataaatttccctctacacactgctttaaatgtgtcccagagattctggtatgttgtatctttgttctcattggtttcaaagaacatctttatttctgccttcatttcgttatgtacccagtagtcattcaggagcaggttgttcagtttccatgtagttgagcagttttgattgagtttcttagtcctgggttctagtttgattgcactgtggtctgagagacagtttgttataatttctgttcttgtacatttgctgaggagtgatttacttccaattacgtggtcgattttggagtaagtacgatgtggtgctgagaagaatgtatattctgttgatttggggtggagagttctatagatgtctattaggtctgcttgctgcagagatgagttcaattcctggatatccttgttaactttctgtctcgttgatctgtctaatgttgacagtggagtgttgaagtctcccattattattgtatgggagtctaagtctctttgtaagtctctaaggacttgctttatgaatctgggtgctcctgtattgggtgcatatatatttaggatagttagctcttcctgttgaattgatccctttaccattatgtaatggccttctttgtctcttttgatctttgatggtttaaagtctgttttatcagagactagtattgcaacccccgctttttttgttctccattttcttggtaaatcttcctccatccctttattttgagcctatgtatgtctctgcgtgtgagatgggtctcctgaatacagcagactgatgggtcttgactctttatccagtttgccagtctgtgtcttttaattggagcatttagtccatttacatttaaagttaagattgttatgtgtgaacttgatcctgccattatattaactggttattttgctcgttagttgatgcagtttcttcctagcctcgatggtctttacattttggcatgtttttgcaatggctggtaccggttgttcctttccatgtttagtgcttccttcagggtctcttgtaaggcaggcctagtggtgacaaaatctctaagcatttgcttatctgtaaaggattttatttctccttcacttatgaaacttagtttggctggatatgaaattctgggtttaaaattcttttctttaagaatgttgaatattggcccccactctcttctggcttggagagtttctgccgagagatctgctgttagtctgatgggcttccctttgtgggtaacccgacctttctctctggctgcccttaagattttttccttcatttcaactttggtgaatctggcaattatgtgtcttggagttgctcttctcgaggggtatctttgtggcgttctctgtatttcctggatttgaatgttggcctgccctactaggttggggaagttctcctggatgatatcctgaagagtgttttccaacttggttccattttccccctcactttcaggcaccccaatcagacgtagatttggtctttttacataatcccatacttcttgcaggctttgttcatttctttttcttcttttttcttttggtttctcttctcgcttcatttcattcatttgatcctcaatcgctgatactctttcttccagttgatcgagtcggttactgaagcttgtgcatttgtcacgtatttctcgtgtcatggttttcatctctttcatttcgtttatgaccttctctgcattaattactctagccatcaattcttccacctttttttcaagatttttagtttctttacgctgggtacgtaattcctcctttagctctgagaaatttgatggactgaagccttcttctctcatctcgtcaaagtcattctccgtccagctttgatccgttgctggcaatgagctgcgctcctttgccgggggagatgcgctcttattttttgaatttccagcttttctgccctgctttttccccatctttgtggttttatctgcctctggtctttgatgatggtgatgtactgatggggttttggtgtaggtgtccttcctgtttgatagttttccttctaacagtcaggaccctcagctgtaggtctgttggagattgcttgaggtccactccagaccctgtttgcctgggtatcagcagcagaggctgcagaagatagaatatttctgaacagcgagtgtacctgtctgattcttgctttggaagcttcctctcaggggtgtactccaccctgtgaggtgtggggtgtcagactgcccctagtgggggatgtctcccagttaggctactcaggggtcggagacccacttgagcagggagtctgtcccttctcagatctcaacctccgtgttgggagatccactgctctcttcaaagctgtcagacagagtcgtttgcgtctgcagaggcttctactatgtttgttattgtttactgtgccctgtccccagaggtggagtctacagagacaggcaggtttccttgagctgctgtgagctccacccagttcgagcttcccagcagctttgtttacctacttaagcctcagcaatggcgggcgcccctcccccagcctcgctgctgccttgccggtagatcacagactgctgtgctagcaatgagggaggctccctgggcgtgggaccctcccggccaggtgtgggatatgatctcctggtgtgcctgtttgcttaaagcgcagtattggggtgggagttacccgcttttccaggtgttgtgtgtctcagttcccctggctaggaaaagggattcccttcccccttgcgcttcccaggtgaggcaatgcctcgccctgcttcagctctcgctggtcgggctgcagcagctgaccagcaccgatcttccggcactccccagtgagatgaacccagtacctcagttgaaaatgcagaaatcaccggtcttctgtgtggctcgcgctgggagttggagactggagctgttcctatttggccatcttgctccgcccccaacttctttttcaaagagcaccttcaccccttactggactaaagtcaatccgaagctcttttctctaagctttataacacttactgcctggatgagtcatttgtcaataatacagactatttgtattggtgggtttcttgtatatatgtacgagcccctagagtctctaacttaaaatttatttttgctttagaagttcaggattaaggaggctatgatgatcaattttaacaacctcaataaataatacagtaactaatggttaggtatccaggctagcccagggcagcctgtgtgattcatgctgctggtgaactgtggctggctgggtaaactagatctgaaattctgtggtgcctaagggagggaagggaatatttcccacactatctcatcctgccctcactatccctacccgcaatctctctctacactctaccccacctaccctgctttttctgtgaaagaccagctggggcaaatattttggattaagtaaaatttgtcttgggtaacttcccaaaaatttagtttttaactgaataatcttggttaatccatgagtaaataaccttgtagactatagtcagcctcactgtgagaagctgacaaattagaacaccagaggaatatacaccaattccttcctgccctgcaaacctctgcttcttgaggtttattaagagtgggtgcctcggccgggcgcggtggctcaagcctgtaatcccagcactttgggaggccgagacgggcggatcacgaggtcaggagatcgagaccatcctggttaacacggtgaaaccccgtctctactaaaaaaaaaatacaaaaaactagccggccgaggtggcggacgcctgtagtcccagctactcgagaggcggaggcaggagaatggcgtgaacccaggaggcggagcttgcagtgagctgagatccggccactgcactccagcctgggtgacagcgcgagactccgtctcaaaaaaaaaaaaaaaaaagagtgggtgcctcattgattagtcattagttattgacagaaccagagagatatgcctggctcctcttggaaaaaaccaaaagactgaaagggaaaagtacatcagaaagatacccaaggaggcagactgctataaggaaaataattaggagaagaaatcatatgttttcagatgaatagaatctggggatgaaaaaagcagccttttcaggcagatgatggaaagatagaaactaaattcagaaggattagaagatgattagaaggacaagaagccacagaagaccaagatttctcaaattaccaaaagaaggtaagcctagccttgttcagtctgcagaatgagaactcccttctagtagatccgtacaatgaatttcacaaaggttgatttccctctctcctctttgagcccataatcacctccttctacgtgcacaaccttgaccatcaccactacctataacaaataaccagttcttatgatcccctcaaggcataacacaaaaatattttctttgtgattactttctctacacaaaagagagagagagagagagagagagagagagagacagagacagagacacaagtcaggggacttcgttggtgagtttagaccacagcaagaacctaaaatcctagtgggttgtcaatatagacaggctgaaaccactaagatcctgagtggtggttctaggtaggtatgcccatcagaaccatctgtggataagtattctcagtaaatacacatgcaggacctctacctcagatgtactgaattgaacttcactgctggagctcaggcatttcatatttgtttcctaagctgctataacaaagtaccacaaacttgatggcttaacaagagaaatgtattctgtcacagttctggaggccagaagtccaaagtcaaggtatgaccaggactggttccttctggaggctctgaggaaaatctgttccacacctctctcctaggttttggtgactgccagcaatctttggtgttctttgatttgcagaaacatcattccaatctctggttctgtcttcatttgactttccctatgtctgtgattggtctcctttctgtctcttataaggacacctgtcactgaatgtagagcctatcctaatgcacaaggagctcaattataccttaactatatctgtaaagaccctttttccaactaaagccatattcacaggtaccaaggtttaggacttggatatacctttggaggatacagttcaacccattatacatatgtattgaagggaaaaattcacaccacaactgattctcctgtaaagaatgttggccttaatgcatttaacacaccatttctccagcacttaggaaatgctaggacatgcaaagctaaagctaaataggcttctttattgcagaacctctcagaggctctcatctgtttgtgtgcattataaatgtccaagagaaaaaaaagaaccataacatttcctggaaatagtcgaccagggaacgtcttttcaagggattacctattaactacctcaatggacactaatgactaaaggaatacaggctgctggtgattatggcacttccaaagtatgctcaatggtgtgggcatgagtctaccacagtgtataaacacttagagtgttaatgtctacactgacctctccctggatatgagcacacatccttcatcaaatatccacagtggtttccctagaggatttgcatatgcgcatggaattttagatgtctagtctctactcttgccttcagccatttttgtagagagaaattggcaaaatattagcatgcatggaagggaaaggtggccaagataatacattatgcctttttttccccctgaaaattgcccagaatatctgaaaagggagaagtggcttaatcatttctattcccacaattctgatcctacaaaattgatatcagtatatgattcatccagaagttcacagtggtatttttttaaaaaacacttttagaggttaccagggcatctcactgttttaaaatttaatacctcaagggaagtaagcaactaccttgaatttttgcatgaattgcattcaagaataactgaatagttcgtggaataaagttgattttttaaaagtaggcatattctagttaataaatgtaaaagaaatggtaggattacaaaatcactacattacaaactctaatgacataatagatttaagcaaaatgatcagtgaatgataaaatatttaggtatgctctcttccaggtgaatcaagctgacaataccttggacccacattagtcttaccacatgatattatatgtctcctgatacttaaaataaatatcaaataaatgttgataattgttgaaacttggtgatgaacatatagttcacagcaccacccgtgatggattctttccatgagaattgatctgaatcaaagcaagcctctcggtctaactgccagtgtataggaaataaggatacagtaacatttttaaagtctttaagaatgcagtaagctgaaagaaattggtttctgcaataacagcaacaaaattatgtaataaaaagagagagggagaatcatggatttatacaaacttaagagacgttgtgttaatctaatgtgtatcctgatcaaacaaattaactgtcaaaagatgtcttttgagatatgttaggaaatttgaacataaactaggtattctatgatattcaggaatcatcgctaatttgttagatacgacgttggtatgatttttttgaatgagaaagtttttagcatcactaatttgttagatacaatgttggtatgatttttttaaatgagaaagtttttagcttttagagacacatacctagatagttatggatgaaagcatgtgatttaaaaaaaaaaaaaagatagtggaagtacacagaacaggattgctaaatgttgataattgttgaaccttgatgatgaacatataggaattaattaaaccatattttctatttttttgtttattttgcaaattcaaaaataaaaatagaataatccctcatgaacagatggcctcaactttcatccccaagtaaacacaattcacattctcagtggaacccatgagaatattatgaagtatatgtctatctcatttcattatatatggaatcttaccattccctttgtctttattactagtggccagagttctatcttgaaatgtgggaaatgtcctatatgaacaaattagtttaattactgtgagaaaaccagaaaatatttgagttctagctaactggatattgaatgagttgtgctgaagtatgtggtcctgaagggttgataatgaaatatttgctttccagtggcaaggaaaaataaatgtcttagctagaatttacaaggtcattcttgaaatcaatcaacctgggctgaagatttcattgctgctgttatctggcatgatggtattgtttgtgcacagttctgttgatgtgagctatcaaatatttcttagaactgaaatcatataatagcaaacactgctatgtcccaatggagattccaagactcttttaccatggaacatttacattctatcccctttcatcactgctgaacaaacaaaaacaaaaaaaggaaagataaccaataagctttttatttaattgaaaaccaaagagagagagaggaaagaaccagttagttgccattttctaaatgcagacttttgtttctttctgccttccaattctttgctcttgaagctatagctttcaagcttgtgtataaaggcccagagagaacatttgaaatgtggccaccctacccatgtccatgccactcttcctgcctttctctctgcctacttctgctccaccatcccaggtcaggggctgggaggctgatagcattacaagtagtatagtcattcaagctcatataaacaagatgaaatccaaataataacaaaaagtattttatttcaagtactactcagttccttcagttttgctgaccgatttctaggagacctaggctcagctcttggttgtctcagaactgaggacagtactcatttgcaccatatgcatctgcttgttagcctatgcaaccaaaattgattcattacttggccttctctgaaaagaaaaatgaaaaaaaatgcactcttaaaaataattcttaaaatacaaccaggaggcatgtgcctagacatggctcaccttccaccaaatcatactttatgatttcccacaatgttaccttctattcctcctgcccctaaggttctatggagcagagcaggttgaagaatgttaaggttgtactaaactttttagaatagaggctttggggaagcaaatgagaggtacactgaaaatgaagtatctgtctctgctcctattaatgtcacaggactagaagttgacctcatagctgattagagatggaccctgcaaattgaaccccagcacatgcctctcattatccattcttctctttgcagaatggggtccatgctcacatatcaagaaaatggtgggtttcagtctggctcactgggtgaggttttggcatgcaaactaataagagttagtgtacatcacccataataaaagtaaaagctttatttttatttccccaggtaaataagcaaaagacagatctaaaatacattagagttaagttccatggggacagaaatgtctgctttgtttgttgttgtatatttgacacctagaatggtggctggaccatagtgactacaaataaaatatttcctaagggaatgaatggttctgcaggatagatgttctctgcatttggataagtgatgatactatagactcagagcctagatagaaaatattgtcccactttcagttctgcaagttgacttgaggtgcttggcgatgtcctgcagcaagcaaacccaatgaaggcatctctgagaccccgtagtcaccaccgctagcctcccattaccttgcccaccctagattttcaaattgggaatcattgtggtaccagattgggaatatttgacttgcatactttctcatattggggcttaggattttgagatcttacttccttttttggcttcttgagatctgaaattgttgttcagagaagcgtattaagacaatgattcttccattaccatgcatttctgttaccaacagaggaggtaagtgaatcacttaaaatgatacaattccatccacttcagtacgctataaacatatccttagctttgactataattatagtatgtgggtgatgctgctgagaaaatggtataattataacattatggttgagaattgtctgagtagaaagcactgagctgtactatgcaaagtttaaggcagcattatgggtcccttttcaatatgaataaaattgattagccaattgcaactgagagctttgtaaaatgatattaataatataaaaatcagctgggcgtagtggctcacgcctgtaatcccagcactttgggaggccgaggtggtggatcacaaggtcagaaaatcgagaccatcctggctaacacagtgaaacccgtctctactaaaaatacaaaaaattagctagctgagtgtagtggcgggcgcctgtagtcccagctacttgggggctgaggcaggagaatgccgtaaacccgggaggtggagcttgcagtgagctgagatcatgccactgccctccagcctgggtgacagagccagactgcagtctcaaaaaaaaaaaaaaaaaaaaaaaaaaaaaaaaaaaaaaaaaaaaaaaaaaattcaggggccaaggtaaaaatttaggaaaaatttgatacttttaatttcttttacttataggagtcttgtatgcaaccctaatgcaaagtaaagaagctcaccaacttgaaggaagcatgaatgaaattacaaggaaaagctagcttaaaaaaatcaaccctgttacttggtttttcccctctttgctcttggcaaaaggatcttacatatgtataccaaatgtctatttgaaaattttgtttccctgaatatagatttcttttctctttaacagactgatccaatggttgtagattttatgctaccataaattaaagaagacagcattctatatcatgactgaggtgttaatgacattatgcagttgtcacattttgaaatataaacttaaatgtgagcttttcactgtgtgtaaagtttatctgtattaaaattttttttttaaataccagagatttcagcaacaagaaacataaagaagtaaaaagtacatagaaaccctgtcctagaggacctgttccgccacttaaaagccatgtacctcttgaagcctgtttcctttatttccaaaatgggaatttttatatttacaccctaaccatcacgtgggtcacatgtgataacaatgtgcaagtttcttacaagtgttctagaaatctgtaagtcttagagttctgaggtttactcccaaagaagtggaaattgtgggttgcaccaaacagttaaacagggtgacagggaacccctgtcacgtacccaggcctttgggttattttctagggtgagggaacatggccagtagtacaaagcatgtgagtgtgtggatgtgggtatctgcagtggatgagtgggtgtgtatgtttatgtacaacacatgtgttggaggataaaagggaaaataatttgtctttgtgacttcatctctattcctggcttggaatgttattcctctctacacaaagcatcaaaacagaaaccccttcccttctttattatatcggaaatctggaaattcagttatccttgtcttatcctactccctgctctgttctaaatatataataataataataataagtaatagcactagtagtagtagtcgtcgtcatcgtagtagtagtagtggtcgtagtagtagtagtaagagaatgaagagatggaggagaagaattggaaatagggaggtttcctgtacctgactggcagtttatatagcaaccgcctgcagatttaggtcgtttcttacttcgcttattttacagcaacctcaaccaactgtgacaacctgcaatatctttagcccttaagatactgtctcttaaacctgaccaatatttcttatttctcaaagagtaatgacaatcttttctgtctgagaacttctaaagccacaattgattttcctcacatttccctcaaatgaaaggagtatttgaaaaatggaactcaaaggaggagccacctcagaagcctaactggagcagtcagactctgcatcaacagacttggcttcagttctcacactgatacttactagctgtgggatttttggacaagtcacttaacccctgagtctttagcttctcatctgtaaacaagtataaatactacctacttcataagctcgtatgaaaattcccacaaagtatgatgttagtttcctttctttttgtgctcagctctaaaaatatgcagtgtagtaagtcatcaatatttcattaacataagggaaaactatatacccaacccaaaagctgagattcttcagaacattttttttaaagagattctaattgggaattttataaatggaatacagagtactttttaaataataataacaatgattaatttaaagttactaaacaaaataccttaatgaatttgggaaaaaataagctaaagataaatattaagcaaaagagaaaattattaaagtaataatgtacaagtcacttgatacttgcaaagtaacacagaattagacataaagccacattcaagaggcagcaaagccaaaatggctggctggccccgtttgaaaggctcttggcaacagacatacggaaaactctcatctctttcctgggccttacttcctactctggataagcagcatctttcacacaaaagaacatatccagaataactaagaaagagatgaaatgatttatcggaactagttaaaataattaaatcttaaaagcatgttcccctggacatagagtggggtgatttctgcaaagattttgaaaataaagtacccctaaaacaaggatttggtttaactgcttgaaaacaatgtgacaggttgagaaaactgaaaattttcttaaaatcttgtttacttgaatggtgagccagccatccaggggagaaaccagagctctttccttaaagaaatacagacttccgttggaagaaaaaagttggtaggttttaaccttcaaccttctagtgaagtgagaatattgattgagcatctattactagaataaatttatcttaagtgacccagggaagggtcatgggtgataggaactgtcagagagaaaaaaaatacatggttgtggatcttaagtacttacaatctactgagggctcttgtctgcattttccttagatcgtgatgttgctcaaagtcacataagaaagcacataaatttactgaataatattaagaaagcagcagtgacactgaaatgcttgcattctgttcactatcccagtcatctgcagttgcctgggggatttgcaagcaaggacaggaaaatgctagtaccaaccagttctagataatgaatttatttgctgcaaaaactttcactgtattaaattaaattagattgactggaattaaaaggtaataaggcccattttcttatgtaggtcatcaattactttaactctaaagataattccaaaagaagaggtttaaaaatcgtttgagtagtagtaacatcattggaatttatttgaaacttcccaatgtgctcacttttacagataacatatgtatatatatatttttatatatatatatgtatatgactgctggcataatgattaaaatgatcagttttattactttgtaatcacatcaagtaacaccgatgattgaaataaaatctgttagatgagtgaatgcaatgataatgtatagcagatgaaagtctttgctatgaagcacatgattgttgtaattgttgctgctcttttgggatcctgaaccagattccccaaataagtaggtaacacggcatttgtcttgagcactttttcaagcattgtaatccatgcattgaagtagacattatcagcctacagctgtaaactctaagatgattttaaagtctgaaggtttataggtcttcattaggataagctgggctcaccatataaatccttgaggactttgctagaaaaatagtggaattattgaatagggaaaagagataatggtaatgggatttgcctgatgtcttcatcctagaaaaaaagatttctgcttgggcattaagaatgatgattctggaagactttcaggaatgttgataaggcttgagttactcaggatttgatgccaaagaagccacactgcacatgtgttcctctaaggtgtacttggttctcacctgagaggcaaaggctctacttattttttgattgtttggtcctaagttaccttcaaactccacttaaccgcatctctaatcctgcgtattgcctttccagcatcttgtaaattccaaggggttgggggaacctctaggttccaaggctaagctaagttataaatgaataccctgtgcagtgttgagaatgaaacagaagctttggcgcatggtagcccactatgaatgcggtttcagaggagcagtccaggcgccctcaatgaataggcatatatgggccaagagacaggcctctcagccataccacagtatactggaacaatgagaaatgggagaggacatacttcttacagtgacacactgacctgttttcattctgtcctctctctgcttctccatttccacttattgcctgtattgcatctgtccagtaactgtttctttaacagttttccagactgacattattaatccagaagatggatggtagtttttttgttgttgttgttgtttgtttgttttgttttgtgatggagtctcgctctgtcacccaggctggagtgcagtggccagatctcagcttactggaagctccgcctcccggtttcacgccattctcctgcctcagcctcccgaatagctgggactaccggcgcccgccacctcgcccggctagttttttgtattttttagtagagacggggtttcaccttgttagccaggatggtctcgatctcctgacctcgtgatccgcccgtctcggcctcccaaagtgctgggattacaggcggtagttttttaattaaaagggaaagctgattttatttggtgagacttctgctatcatcttccgtgttatatcccaatatgagtatttttttaaatgttctactaaatccaatagtacattcacctcactcttgagttaaactcttgactttaaaaaaattagccagaaaaaaaaatcataagaaaaaatgcagcattttaaattctataaatgagctatgtcttaaactatttgggagcataactcaattgtattcattttagtttaagatcatgcaaaaagggaaaggtatagatgctattttattgatatgctgctccacagatttcaaattcaacatcataagccaagatttgtgggaccagaggaatgttcaaaagtataatctgataaattatctgttgcagaaattaagtaaaatattgcatacatctcacttcctataccaaatagatagaatgaaagtactagattttgtatcacagatagtttagacaactacagggaattctgaactttcaaacttttatatcctaaactcaagatttgggccttgaaatataaaactgacaaaactgctacagtgtggatttttaaaattacagttttcctgtggtagagttgacactttctgttggtatggctagaagtcagatagatgcttaatgttaaagaccatgtttttatttcttctctttttctcaccctatgatttcattgacctaaagtggcttttagtgctgttcaattcacacagaagccaaaattggttactgcgttaagaagaaaccaagaggttttatttagttcatgaaacattagcaaaacttctgtttgatgcaaaactgcaaggaagttttgtagtcattgaaaggagcaagaatatacagattgcttgcagttccagtgtagagacattcattatcagatttaccacttgaaaagattatcaagatagtatttttattgtgtttaccaggtaaactaagaactttagttctaagcactttacctattttaaatcattaatagtgctgtaacaagcctctgaggtaggtactgttatccctctttaacagataaagagaatgaggcacaaggaagagaagtgacttgctaaaagcacacacagctgaatgtggaccctgattcaaatctacacatcctgactcaagcatcgttgctctgtattactgtgctacagtgcctcttcacatcctcctgatgcagaaatcttcttctagaataatgagaagcagtgtgagctttgaagtaggacttcctgagcatggtgctttccatcatctctgggccaaagttttctcatctttacaaagggattatgatcaacccccatctcatactgtggttaggagaactgaaaaagaccattatactaaaagatgtcagaacagggcctgacagatcatagggcccaataaacatgagctcttgttatcatcataaatatgttaaaagcagccttagtatatggataatagtagcagaatttcctgaatgagacatgttaaacatttattaagtgggcgctttttagagtttatcctataataattcagtaaggttactcttgtcatccccatttcactgaatttgaggaatctcaggctacaagataacatattagttttctagaatcaaataagcaaggattcaaactcaggatgtattgatcccaaaacctcagatatttctgccgtccctgtcttgttctaaaccccaggtttgctcatccaggccctagttattgatcaaaaagcaccaatagaaatcagagtagagaaagtcatattgagcttgtgagattgcattatgggcgtggtaacaaatgtcattcagatgttttggcacagtgcataacaaccatacttaacctctgtactaagacctgtctgagcccataaataaagttacattaataattatggaatgataagggaccactcagaaaatcttggttgatataggaagtggcgtctgtggcttctaattaagagatattgcttcttgaatcagttcctgaccattgctctagggggatattaagccttctctgtccatgggagatgtgaaattcaacagctgacctgactgcttgtcgctgttgatgatcctataaaatttcttctaagataagaactctgtgttctagtccaaatcaagtgaatatttcctgtttgttgacctacagcttcaagggtatgaggtcataagtttaaaaagatttcttttctctccattgttgtgagagtcattatagttctatcaaatgctccaagtgaatcctgcatatttcctttttgccagatatgttagctattcactctattttcctatctcctctatgcttttactttttccctcatctgtttaccaatggtaccctgaattttagaaccagacaggtagtaggacaaggcaggtgaaactacacaggttgtaaatttcagaatgcaggttcaaatttcatcgttgtctcttgctaactgaatgaatataggtaagatgttttacctctcagagtcttacataccccatctgtaaaatgggaataatactgtcttccatggttttcttgagcattaaatgtctctatttatggaacacagtttcatgtagtaactgattctgtaccaatgccctgcctcctatgtaggcaaatgcatgtcccaaaagacccaaaacaagttgtccctcttttcaagatgaagctttgtaatctctccttaaatttatccagttctggtgtttaatttcctttataagccagaagttgtcttacgtctcaccaaatcttataacatgaatataatactgtcttccaaatgtgagcctctaattaccttaggccaatagcagagcctctgatcttatcttttctccttttccgcttaccagacagcacattctgctgagagttgggacccaaaaagatataaatcaactagggggcagaaatggagattcctaagctcctcccagagtttgactcagtaggcctgaggttcaggggcttgatgttaaacaagcaagcccagtggttctgctgcaggtggatcagactcccaagaccacattttcctagcactggcctttaggaagagcacgtgcctactctatcagagtttgtgcagactatgattgcagcctagtttatgcagactattgattgcagcctcttggcaaggctctataaggaaaagggagccaacgtgtaagtaaattatcacggccatgaaactcctcatctgagagggtttcctctcatcccttcatccctttgtgtctgccccagaatgccagactatcttctccagatagacccaagtcaatctcttatttttaagccattcctcattctcctatatagtccaaaatagcaaatacatttttaggaattctcttgctttatgggtgttcatccaaaaatatttcattataagaataagtgcttagcttatcctgtagtgtctttctgctctgatatttgggcccttcctttccacatagttgcattttctttgatgggcagatgctgcttctttaatatttttcacaactctgtgcttctaacagagcaattatttcaggaagagggcacttggagagttgtaagaggctaaggagcccatgtctctgccttggatttgtgtacctaaatgttacctaattagataaacctgaaaaagatttggaagcaaagtagaatgaaatggaaagtgtttggataataagaatttggacattgttgctctgtggtgatgttggcagactctaagcttcttgcctcattttattcattcatgtatgaaggagttatactcagtcataagtcactaaaatttgtattctacatcccattagtaaagtatttttgaacacacatgatacatatgtttacatatttgtaagttatatatatgtacaacgttctaatatattctgttcattgtcaaacttaaatatatataaatttggtttaatataaaatataaaattagcattagtgtctgtgtgtctgtctcatttctgaaaaaagcgcaatatgtactaagttaaaggttcattcttaatagcagtaggagtagatctttatttcaaatagtctttggggtaatttcctgttttggaagacagcttatcagatttggttagagttgatgaaagcttattctagggttaagaaaagtattagctcagccattttcttattgttgatttgggcttgcataattaggtttaccttcagtatgaagtttctttacatgaatctgtttaacccacttatttgttatataattattagttaaatgaatgttaaatcagtataatctatttatccacaaaatcggtcatacagaacctgcaaaaaaaaaaaaaatgctctaacatgttacatgaagagataactaaagatactacaaacaacccctctgaacagtaacactcccactcttcctgcaaaattcctctcatagcaaatgcaacatgtgactcagacacaggctgactgaaggctttatgtgactcttacatgcccaatattagaaaaccttaatttctttcctattttttataaacaacatatataaacaaacattttagtatattctcattacccaatggatggtcttgcatggtccattttgaagacagtaaactatagcctctatttttatttaatttcaaatacctgtttgccaatattcacagccagcttttgttaatgttcttttctgtcctgtgaatcctgatgtcatatcttgcaacatccactctaaagcctatctttgcactcccgtccatcccccattctctattattgtgctgcctctgatggccagagaaaaaaatcttgaaaatacatattgtattgccctacgggtagaggaaacagcagttatacaattcaaagttgcagcaattcaccacactgtttagcaccctactaggtgtaaggaggaagcttgattttaaaaatatatgcaataatgccttcttcaagaatgtttgggagcatgcaagagcttaatgctcatggacatttactttattccagcaaatttagacccaatctgtgtgtagtttcattttgttttccatttcctgattaactgactatatatctagctacttatttgctgccatctagtgtaataaaatatgttgattatacatggaattttgagcccattatgtagttgaatatcagtactcaaaatgattctttttttctggtttcttataagtttacaaaatgcctagtcagggacctttcttatcactgtaaccctgaacgtggtcttaatattgtgtcatagtatctagggctcaggatcatgagccttccttcattttctataaacgtgacaattggaaactgggtaggggcttagcagttggtggatgtgaagtaaatatataagagtaatcattaagagatcatctcagtttagtgaccatgatttttacttcatggaggcagcaaaacacagcatggattcttaccaatagtgtgaccatgggcaatttatttctcttttggaggcatcattttcttcatatctaaaatgaagtggtaggtccaggtgactgttgaggtctcttccagctctaagagtctgtgtctacatataaatgattttctctgccaaagtaatgtttttagagtcctttataatgccagaaatgaatacggcttctctagtttttctatgtagctatctatcctttggtgtggttagaagtaaacagcgatcctgactggaaagagagggaggaaaatgtggactatgattttattccttttattcttgagagttgtccaatgggatattgtcccctagtggataagtagatacttgccaatatgcacctgacctcttcactcataatgggaatttagaagtataatacctgttataatcaacttcctaatctctatccctttttttatcactctgtttcctattgtaacttctctatgtggtactataagtctacagtaacatataggtgtttccctttccttatgaagttttatacagctactccattatatcctaaaatgttcctttttcttgcttttatagtggggtctttattgttggccaggctggcctcaaactccagagttcaagtgatcctcccacctaatagtagctgggttttcttctgagtagctggtcctaaaatgttttattttcagattatttcaggtgtataagtcttattttcccaaccaggctgaaaacttttcagaatcaagaactgtctttagtttctcattttttatgagggaatgtggcattattgcttagggaattcatgtattttgataataaagatgcttttctgtttgttcatataaattagggtaaaagaggaagtataaacctatctcaaatcaagtacaggactctataattattactggctatctaacagctcatagaagccaataagtctctgaacctaatgccaaagaaagcaaccttaccataaagagaaaatccaaataaaactaaaagaggcaatgggcagtgctacctatgggaagaaaactggcttcacatcccagctttgctacttattatctttgtgttttggctaaaaattgtctaactttcctgaagttaagtttccttctctataaaatgagggttataatactatatacagcacactacacaaaagagttgtgaagatggaatgagaaagcaaatggcaaaaacttagcacaaagtaggagctcaatcaatcatggttaaaaagaacttttatccattgttatttttgcttatatacagtaaaaattatccaagacaaatgtagtcagagcatctgcaattgagctttataaagtgaaagataattctcataccatagtggttctcatcaagggtgatttttgtcccccaggggatatttggcaatgtctagagacattttatttgtcacactggaaaagaggggagtgctactggcatctagtacatagagagtaggaatgatgataagcattctgtaatgcacaggacagcattccacaacaacaaatgatctgatccaaaataccaatagtgtggaagttgagaaaccctaccgtaaagcctagggagtccattacttctgacctaaatttgttttatgtttaagagtgcatgtggatcaaaagtagcttccattttggtaggttatgaagggagttgtctaatctggtgctttagattctaatttggggcatatttttaggctaaggcattgcaatatataaggctttctaagtttcagacattttcttggaggtcagcaaacgaaggcttgggtatctattaacccactagagtagtgtaataatggtggtggttctttattgaagactctataataatctgatttatttttcggcaactgtataagacaggtattttgctctcattttacacaagggaaagctggagcttagagaatttatgtaacattactagcaagttgcacagctgggattcaaactgaaatcctgctagcttcaaagactgtgctgtttctactgatgcatactacccctacctaccaaggctctgagattggaaagcaggatgggtgtgttttaaaggaaataaggtaggaaagttttcaaatattagaaattctgctcaagaagattaggtcaagtttcctgctgaggggcccttgagtatccatgaactcgatgaaaactatgagcttctcaggaaggtagaccaaagggaaaggattactccatcctcacgctgtcataaggacatacacaagactgggtaatttgtaaagaaaaagaggtttaatggactcacagttccacatggctggtgaggcctcacaatcatggtagaaggtgaaggaggagcaaaggcatgtcttacatggtggcagcgaagaaagcatgtgcaagggaactgccctttataaaaccatcagatctcatgagacttattcactatcatgagaacagcacaagaaaaacctgcccccatgattcaattacctcccaccagctccctcccacaacacatggggattatgggaggtacaattcaagatgtgactttgtatggggacacagccaaaccatatcaccatgatatacaatttgccaattcagcaacagattttaagtcttatatttttaagcatgatgcaatatattttatgaattcttcctatttatatgttttccttttaaataggttctactatcttaactatcactttcaaatataatgcaagctacatatgccattttaaattttttagtagttacatttaaaaagtaagagggtgaaattaattttaacaatataggttatttatcccaatatatccaaactattatcattttgacatgtagtgaagctcataaaagcattttattattatgagatatttcttacattattttttcctaatacatcttcagaatctgggtacgcattttaactttccagcacatctcaattgggatgcaaaattttcagcaattaaagcataatgtagccctatcaaaactattaacgttgtgtttaggaaaaaaaaatatttttcactgcttttatttttaaatttgagcttaaattaattaaaattgaataaatttaaaattcagttctcagtcacactagccacatttcaagtgctcaatagctacaaaagactcatggctgccatattggacagcacagatctaagctcttattgctcagaatgtggtccccagagcagcatcaacagcatctgtgaactgatcaaaaccaccaatatttcagttcacacctactgaatctgcattttgtttaaatgttttttatatatatactttaagttctagggtacatgtgcacaacgtgcaggttgttacatatatatgcatgtgccatgttggtgtgctgcacccattaattcatcatttacattaagtatatctcctaatgctatccctcctccctaccccctccccacaataggacctggtgtgtgatgctcagaatctgcatttttacaagatccccaggtgatgcttgttcacatgaaagttttgtctctctaaatcgcagatctttccatcagagcccagaaaaagcacaagaatcaataactgtgaggaataaggaaacttgccacaggagaatggtgctagggttggtattaatgatgtgctctggtaaaaagtcataagtttcccagaaaggcaacaatggctattctattgtttgaactgacacaggtctattctagagcttggacttggctctgctcccagaatctacatcaaagaatctaacactaacttccatgactaccacaattaaggcagctgcataccccaccactatatatatttgaaattgcaactttagaactctgtaacacagccgtgagcatgtttctgctacacacaagtggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcactaatccttatttggtttgtttttcacagaactcagtatttgatgggcctttcaatattttcctttaaggaattcattgtactaatatgacatagaagctcattgttctaataaatggtccccaatgttggctgcacattagaatcacccggggcattttgaaaaataccaatgcccaggcatcacctcaatctaattaaattaaacctgtggaaggtattttgttaaagatccccaagtgattataatgtgcagccagagttgaaatccaccggtccaattagaaggaggccttagctagcagtcaggtgcccaagtaaatgcatctcaagctttaatgcgcatacagatagcctgggatttgttaaaatgcagattctgatccagtaggtatgggtggaaataaacccacatttgtgtacagatgtttctcttgtggtatgtggttggtgatcattctcagtatgcttccatttccggcaaactgggttgagttgatgaccctattcttactcctccatgaaacctttatctcgcccacagactcccagttctcattaatcactactttctgtgatattctgaaacagttattgtctttaattgtgttttttcattagctacttctctatctgcttatgtacataagttatttcctctactggattacaactcttcaaggtagatccacatatcatgtcatttttataattctcactatacctaaagagtgccttacacaaatgccacttgttgattaattgaaacagggaatagctgatgtgatatctcaaaaaatatccaaaggacttaaaaatgcaagatgtttttctttgttggaccaaaaaggaaagtttagacaggcaagggggtaggagatattgaggctttcaatttttatgttagcttatttcactctgggtacatatttaaattttgaaaaattattttgtaatttaatgattttaattatttgtttgaaatagggcactattgacattttggactagatcattctttattgtggctgtcatcctgtgcattgtaatatgtttcacaacatccctggcctcaacccactagatgccagtatctccctttccccctgtcttgagaaccaaaaaatgtctctagtcattgccagatgtctcctgggaaactcattcatggttgagaacccttagtttagaaaaatggaagtgtgacacagctgtcttactgcactaatatatgcctgaaaaaaataaaaattaaaaacatacacgtaagagagtgacaagttatgttctgagcaatatgtgtatatataaatattaatataaaaatgttctctgttcttgcattttggaggccatgtgcttgtagatcatatttatctttgtatttatcatcttgatcattctctttataaaaatagaggtatattgcatgcctctcagcttatgaggttacatcccaatcagcctgttgtaaatttaaaaaatcataagttagaaatatcaaacttgaaaatgcatttgataccctgataaatgcatcataaagttgaaaaatcctaagtcaaaccatcatgagccaggaattatttgtatatgaaacatttttaaaatctgaacatagacttgggaattttaatatgtagtggtagtaattccaccaagcaagagaatgtacatggagcaaaaattattaagaaacagtgactgagattattctcattctcaggaaactggcccagccccttttcataaaatattctgttcagtgtgctgtgatccttggactgaatatactgtttcagtaagcatattgttcagtaagcatattgttcagtaagcatatttagcttaagcagttgttaagctaaagcctgcacaccaacaggtgttcaatgactgtttgttgaataaatgaagaatgaatgaatattaactgcatctctaaaccctaaaattaaaaagctttagtgtgctcttcacaaaagaccctattttgttgcgtttgaaacttcaagcttcagaaatgaaattacatgcaagagtatattatcatcaatgagaataaatggcctcaacaaaattacaagatagaaaacaaagtttcattggtcagttggtttcttctgacaatagaaggctccccttagacttcattagcttcagatatttcaatgacagaaacataatgttggcaaagcattgctatactttcaggcttggattggaatgccccacatttactttttcctaccattcctggctaaaaacttgacatatgagaaccagacacaaggctctagtggtagcaagcagaatgtcttctaagctccaaaggaaaaaaatgatataagtcagtggttcccaaattaaccatcaaatgctaaccattaaaatcactggggaacttttaaaaatcaaatggccaactaacaacaaactgtctgaaaaagaaatttagaaaaccatcccatttttaaaagcatcaaaaaaataaaatacttaggagtaaatttaaccaaggaagggaaatatctgtttactgaaaactatgaaatgttggtgaaagaaattgaagatgataaaaataaatgaaaagataaatgtttgtggattagaagaattaatattgttaagagatctatgctatccaaagcaatctatagattaaatgcaatcctatcaaaattccaatgtcattctttatagaagtagaataaaatcataaaattcacgtggaaccacaaaagaccctgaatagctaaagaaatcttgaccaaaaagaacaatgctggaagtattgcattatcagatttcaaaatatattacaaagctacagtattcaaaatagcatgctacttgcataaaaacagacctaacaactactgaaacagaatagtgagcccagaaataaacccacacatctatgatcaattgattttcaacaaaggtaccaagaacacacaaaggggaaagacagtgtcttcaataaatggtgctgagaaaactggatatccacatgctgaagaatgaaattagacccttatctcatcctttatacaagaaccaactcaaaatggattaaagacttaaacataagccctgaaactataaaattactgaagaaaatacaggggaaaagctccatgatattagactgggcagaagtttcatggatatgacctcaaaagcacaggcaaccaaagaaaaaaatagacaaatgacattgcatcagactaaaaaacttctgggcagcagatgaaacaactaatagagtgaagagacaacctacagattaggagaaaatatttgcaaatcacatattaggtaaggagttaatattccaaaaggtacaaggaaatcaaactactcaataacaagaaagccaataaccctattaaaatataagcaacaaacttaaatagacatttctcaaaagaagtaagtatcaccctgatttaaaacctggcaaagacacaatgaaaaaacaaactacaggccaacatctctgatgaacatagacacaaaaatccttgacaaaatactaacaaactgaatacagcagcacatcaaaaagttaatttgccatgatagactagtgtgttaggttgttctagcatgctattaaaaaaaaaatacccaagactgggcaatttgtaaaaaaaaaaaaaaaaaaaaaggtttaatttgttcatggttctgcaggctgtacaagcatggtgccagcacctggctagcttctggagaggcctcatggaatttttattcatggtagaaggtgaagcaggaacaggaacatcacacaggggaagcaggagtaagagagagtgtgagggaggtgccacacacttaaacaatcagatcttacaagtacgcactcactattgcaaggacagcaccaagccataagggatccacccccatgattcaaacacctcccaccaaggcccacctccaacattgggcattatatgtcaacatgagatttgaacaggtacaagtatccaaactatatcaagtaggcttcattcctgggatgcaaggttgcttcaacatacacaaatcaataaatctgattcaccacataaacagaattaaaaacaaaaaccacatgatttcaataggtgtgggaaaagcttttgataaaatccaacatcccttcacatttaaaaaaaaaaaaaaaaaaaacccttaagaaactaggcattgaaggaatatacctcaaaatagtaagagccatctgggacaaacccacaacaacataataataaatgggcaaaaactggaagcattccccttgaggacaagaaaaggatgccctttctcacctatcatattcatgacagtacttgaagtgctagccagagcaatcaggtaaaagaaagaaataaaagacatcaaaataagaaaagaagaaatcaaactacctctcttcactgactatataattctatacctagaaaaacctaaagcctgcaccaaaaagctcttggaactgataaacaacttcagtaaagtttctggatacaaaatcagtgtgcaaaaatcagtcgcatttctatacaccagtaatgttcacattgagagccaaaccaagaatgcaatcccatttacaatagccacaaaagaaataaaatacaactagggatgcatctaaccaagaagatgaaagatctcataattctgcacatgatcttcaacaaagatgacaaaattagcaatggggaaaggactctctagtcagtaaatggtactgtgataaatgtaaatgtcagtaaatggctagtcagtaagtgatactgactagccatatgtagaagaatgaaactggacccctacctttcaccatatacaaaaattaactcaggatggattaattattcaaatgtaatatctcaaactataagaatgtaatattcaaatatatctcaaactatatacaaactataagatattctatctcaaactatatacaaactgtaagaatgtaatattcaaatgtaatatctcaaactataagaatgtaatattcaaatgtaatatctcaaactataagaatcctataagaaaacctaggaaacaccattttggacatcagccttggaaaagaatttatgattgagtcctcaaaagcaattccaacaaaaacaaaaactgacaagtttttctgttaagaagccttagtttaagaaaaagaaactaacaacagagtaaacagcctacagaatggtgaaaatattcacaaactgtgcctccaaccaagatctaatatctggcatctattaggaactttaacaattgagcaaacaaaaaacaaccccatttaaaaataggcaaacagcatgaacagacagttctcagaagaagacatataagcagctaacaaacatgaaaaagtgtttcacatcactaatcatcagagaaatgcaaatcaaaaccacaataatatgctatctcacaccagtcagaatagctattatcaaaaatcaaaagaacaaagctggaggcatcatgctatctgacttcaaactatactacaaggctacagtaaccaaaacagcatggtactgataccaaaacagagatatagaccaatggatcagaacagagccctcagaaataataccacacatctacagccatctgatctttgacaaacatgacaaaaacaagaaatggggaaaccattccctattcaataaatggtgctgggaaaattggctagccataagtagaaagctgaaactggatcctttccttactccttatatgaaaattaattcaagatgggttagagacttaaatgttagacctaaaaccataaacaccctagaagaaaactattacctgaatggtaataccattcaggacataggcatgggcaaggacttcatgtctaaaacaccaaaagcaacagcaacaaaagccaaaattgacaaatgggatctgattaaactaaagagcttctgcacagcaaaagaaactaccatcagagtgaacaggcaacctacagaaagggagaaaatttttgtaatctactcatctgacaaagggctaatatccagaatctacaaagaacttcaacaaatttacaagaaaaaatcaagcaaccccaccaaaaagtgggcgaaggatatgaacagatacttctcaaaagaaaacatttatacagccaacagacacatgaaaaaatgctcatcatcactggccatcagagaaatgcaaatcaaaaccacaatgagatatcatctcacatcagttagaatggcgatcattaaaaagacaggaaacaacaggtgctggagaggatatggggaaataggaacgctttcacgctattggtgggactgtaaactacttcaaccattgtggaagacagtgtggcgatttctcaaggatctagaactagaaataccatttgacccagccatcccattactggttatatacccaaaggattataagtcatgctgctataaagacacatgcacatgtatgtttattgcagcactgttcacaatagcaaagacttggaatcaacccaaatgtccatcaatgacagactggattaagaaaatgtggcacatatacaccatggaatactatgcagccataaaaaaggatgagttcatgtcctttgtagggacatggatgcagctggaaaccatccttctcagcaaactattgcaagaacagaaaaccaaacactgcatattctcactcataggtgggaactgaacaatgagatcacttggactcgggaaggggaacatcacacactggggcctcttgtggggagcggggagaggggagggatagcattaggagatatacctaatgtaaatgacgagttaatgggtgcagcacaccaacatgacacatgtatacaaatgtaacaaacctgcacgttgtgcacatgtaccctagaacttaaagtataataataataataataataataataaataataataaaaaagtcaaaaacaacagatgctggcaaggctgcagaataaaaattgaactctcatacagggttgctgggaatgtaaattagttcagccactgtgaaaagcagtttggagatttctcaaagaacttgaaacagagttaccattcaacccagcaatcccactgggtatatatccaaaagaaagtacattgtttcttttgaatattgttctacccaaaagacacatacactcacatgttcattacaacacttttcacaatagcaaagacatggaatcaacctaggtgcccaaaggtgggttggataaaaaaaatatggtacatgtccaccatgggatactacacagcaataaaatgaatgaaatcatgtcctttgcagcaacatggatgcagctggaggccattacaccaagtgaggtaatataggaagagaaaaccaaatactgcatgttcttacttacaagtgggagctaaacattgggtaaacatggatataaaggtggcaacaatagaaactggggagtaacagagtagcgaggtagggagcagaaggaggactaaaaaactgttagatactatgctcattccctgggtgatgggatcagtcataccccaaacctcagcatcatgtaatataccccggtaacaaacctgcacatgtattccctgaatctaaaataaaagttgaaattacaatttttaaaaggatggaaactagtcatcaatgtgtttttaattttccaggtgactctaacattcaataattattttaaatattatttcggtctgtataccttctgccagctactaagtttcaggaattttgatggtctcattaaagagaatctgacaaccccatttacaagtgcttcagctaagtttcatttagaatagtttcatattgccaaggatccagtagtgtcttttttacagtgagttacaaattcctgtttttgtgacagtgacaggccaaaattaatgaactgtgatttttaaattgaaaaagtgactgtccaatggagactaaaaagaaaactaaaattatatttggtcaattttagtgttaagcatgattttttgctttgtatgttttagatagactttttcattgagataaaacccaaatagcataaaatccacctttttaatctcaaagtggtttctggtatattcacaatattgtgcagcaatcactactatctaactctagaacattttcattacctcatcatggaaccctgtacctgttagtagtcactcccagtttcccattcacctcatttcctggcaaacactaactacttttctgttgctctgtatttgactattcttaacattttatgtaaatcaaatactataatatgtggccttttatgtctgatttctgtcacatagcaacatgttttcaaggttcattcgtgttgtagcatgtatcagtattttattcctttttaagacaatactttattataggattataccacatcttgtttatccactcatcagttgatggacctttgggttgtttctacttttctgttactttaaataatgctgttatgagcattcttgtacatgtttttgtgtgatcatgcgtgtttgcttctctgggcatatacctaggagcagaattgcagggtcatatggtaactctgtatttaactttttgagaaacccccaaattgctttccccagtagctataccattttacattctgaacagaagtgtgtgagggtttctattacttcatatcctcttgctttctattttaattatttaattatttaatttaattatctaagatgccctttaccctaaccaaccagaaaataaacttgactgaatttagtgctaattgtttttgcatagttattcagtataattgtccttgacatctcaaaacactgcttatgcagaatacacttttttaaaatagtgaaatcatagcaattctatttcgtaagtcagttcttcttcagggtagtaagttataggtctttgaggtcatgttcctgtttccatcttccaaaaggctacattattagaatcttgttgctgtatctaccttggcatatccccctctctatccagagaaaagatcactgagggaatactgtccccacgtttctatcttagaggcctcattaggagtcactatgcttttaagagatggataaagagctagaaatcaagaggaagagagaaaattttaaataagacagaggagtatatgatcactctttctaagaagattaaatgaaataatttgaaaggcaataaactaactgcaccaagtaaatcttgtgaaagcgaaaggaaagaggagaaggaagatgattgattgagtgttgtctacggccataccaccctgaatgcacctgatctcatctgatctcggaagcaggatcgggcctggttagtacttggatgggagatgattgattgagtgctgaaaactaggataaattgtattcagccaccagcattaagggaagtacatacaatacattttatgaagaaagtgttccatgaaaataaaataacaaaaagtaagtttggtgaagatttaaatgataaatgccaatagtagtatatgtgcaatcatctcctgacactgctatacaaatgagctatctatataggctgtgaccacttaacttcacctgccaaaccacagtgctataaataaatacttttccaagacactacagagttcagttgacttgaaattcatcttacagtaactggaaatgtagactgtgcctttatttgggtcaatcctacagtttttttaatgtaccaggaattcattatttaaagtttactagggtttaatttaaaattataaaaaaggaagaagttggctaggcatggtgactcacgcctgtaatcccagcactttgggaagccaaggcgggcaaatcacgaggtcaggagatcaagacaatcctggccaaaatggtgaaacccagtctctactaaaatacaaaaatttgctgggcgtggtggcacgctccggtagtcccagctactcaagaggctgaggcaggagaatgacttgaacccgggaggcggaggtggcagtgagctgagatcgcaccactgcactccagcctggtgacagagtgagattccatcttaaaaaaaaaaaaaggtggggaggctgaggcaggaaaatggcgtaaacccgggaggcggagcttgcagtgagccgagatccggccactgcactccagcctggatgacagagcgagactccgtctcaaaaaaaaaaaaaaaagaaagaaattaatagttcaggtgagaactggtgaatttttattctcaactctaagctagtaagtgcttaaatagaagacttcacaacaagctgtaccttcctcaattctacagagaatcatgaggaaaatcaggtataaatgtgaatttcttatgttcagtactgtccaaaagaaaatattttattaaattttttgttggttgccatcattatttaaagccttcctgccagtagcctatactatttttggaatggagtgtttgtagtttcataaccacttggtaacaccataggttaaaaaaaaaaaaaaaaaaaaaaaaaaaaaaggctaccagtctttttcaaatggcctctttaacactgctttatagggaagttcagttacttttgacaataatgacaagccaaaaaaatttacacatctattttaccatattttgatacactagcagcatccactcaggacagtacctttattaaaaggggggttaaggtatttttaaatggaggaattcctgaattcctgaagctcttcaaacaaagtagcacttgggatacgacaagagtactttggagaaggctgcttggtcccaaaacagagattcaagaagagaactccagctagctgggtaaggtattccctcctctaagtgtttatgtaggcctgctgggggccaggaactgtgtaaaactcagtaaactcagtacttctcagcacagaatccagtcccaaggaagcacccagcaaaaatttagattgaatttcctttaaaataaaatgaagaaaaaagttaaatttaaaaaaaaaaaaaatacaattcaactactcagcccattctcttcagggtagctttggctcagaatggtggaagagttggacaggctattagggaactcaaaactccccaaacttcagttcagcactcttcctttataatatattttttctgaaaagagtattgccaatatatcaataaagctttttgctatgacttcagagtgtccaggtcactagggaaaagtatcaagtagcatcctgaatccacaaatcctttgagagccagccacacagtatctgcgtgagtctggtaattctctccccttatgagtgtcgtcacagaattgcagcactctccttttattgtttctcaggaaaacatagacaaagcctctgcttggatttttttttttaattttaacactaatatgtaataatacagcaacatctcctagttacctagaactcaggcttcgacagctgtgactgtctagaatacaaccacagaaaatcacctctgaacagtaagggaaatagctgccacagtatcaccacctactccaagcttgttcaacccacaaccaacaggctacaagtagttcagtacagctttgaatgcagcccaagacaaactcgtaaaccttcttaaaacattatgaaatttttttgcaatttgctcatcagctatcgttagtatgttttttgtcttgctcagacaattctcttcttccagtgtggcccaggaaagccaaaagattggacacctatactttggatgtttcatctagtaccaatatacttataattacgtgtttcaactagtactaatgaactttagttacaggatgaaattccaaattagcaatgttcatcatttgctcttcctaggtaacaacagttaacaaatcataggttgacaatcacaactgattttgaggatggaaataataacagtgagcatttatataatgcttactctataccaggcacttttctaagaattttacatagattagctcacttaatctttacaataaccctgtgacataccattattatccccattttacaggtgaggaaactgaagaagttaagtaatttgcccaagattacagattgtatgtaacagaggtaggatttgaactcaggagtctggcaccaaaatcagcactctcagcttctacccagtattatcaaaagtaatttcctggtaacttctatcaattgtcatggcgactctcgagataaagaattattgtttttaataaataatgtcattcccagaaatgaattatgtgtgaatcatactaagctgccgtgagagactgaatatcaccatcagagtggtgaatctacttagtgtaggggtaaaagaccaatctctcccagcagccctacacatagttacaccataattcagtagggtaatccctgatccccatgcagtcataaaaaaggttaaatgatgtttaacagatttcgctaatgattcagagaatcttaaaatacatcttaggaaaactaatttcaggagcaactttcagttagctagaaaatacagttctgttgagcatctcgtaatctatgccagacaaaggagacattcttgcctttctttgagggaattatagaccaacaatcttattaattttcaactttcatcgaggcaagattagcttcatgcacaatgtttctcaaactgaaagtagtgacctatattaataaatcaatttatagtgttgcaagcagcatcatttataatttgaagttagaattaattgcaggcagtaattttgagatattttattttacatgtatgtgtgtgtatctatcatataagtaaatatgtgagaacattttaaaatatttaaaaatgtttacatatttaaagtttaaacatgtaaatatatttatattaataatataattaatataaattaatatgttaatttatatgttattaatttatattaacaatatataaacaatatattcattagtaatatattacgtatattatgtaattgtattatatattactatattaaatatattaaaataatacatttaatatattaataacatactaactatatattattcatatttttaatatatcattttaatatatttaaatttatacttaaaatttacatatataaaaataattttcctgaaagtgactttcaaaaactttgaaagccaccagtgcaatggttaagaatacaaattctgggctggccatggtggctcacacctgtaatcccagcactttgggaggcctagatgggtggatcccgaggtcaagagattgagaccatcctggccaacatggtgaaacaccgtctctgctaaaaatagaaaaattagctgggcatggtggcacacacctgttgtcccagctactcgggaggctgaggcaggagaagcacttgaacccaggaagcgaaggttgtagtgagccgagatcacggcactgcactacagcctagcgacagagtgagactccatctcaaaaaaaaaaaaagaatgcaaattctgaagtgcagctgttgagtaggatcatggctgtgccacttaataaccaagtgactttgggccagttattttacttttctgtgcctcagtgtcatctatttggtagtgagaataatagtacctacctcattctagttttgagaataaacacgttttatattacatataaaatgtgtaggacagagacctcaaagaagacgtagttgctgtcatattgttgttctgttcctgcttaagaaggggacttggaaaagtaatgatgttgaatacagtaacttctttcatcatggaagaattgcatattcacatcttctttgctcatcaaacctttgaagatcatgcatgtctcattctgtaacattgccttaaccaaatataaaggctaaatacaaaggtgtttttaaataactgatacatttaggccagtcacccaaagattttacccaaagcctatgcaggcatagtccaagaagtagactagctctgctgcaatcaccatctcttgtttattatttgtgaaaggaacattacagtttcaccacagttggcctggcaacgtgcttattcagtcctcagaacatatgaaagtgatttcggctgacaataagtatttcctcactttggcttatgttcagtaatagccattctttatccagatcagggtgactgagcatgctgtaaccattcttctcttctaaaactgacccttgtttgattgcatatgcagattgcttagcagaacccacgtccaccataacgggccaaaagtcatttgatccaatgtgcttttctttttttctctctctctcttctttttttaattccatgaaattttattaagataaattaattataaacattacagaacacatttttttgagacagagtctcactgtgtcacccaggctgtggtgcagtgacacgatctcagctcactacaacttccgactcccaggttcaaacgattctcgtgcctcagcctccctgagtagctgggattacaggtatgccccaccagatctggctaatttttgtatttttagtagagacagagttttaccatgttggacaggctggcctcgaactcctgacctcaggtaatcctcccgcctcagcctcccaaagtgcaggaattgcaagtgtgagccactgcacctagacccaaacatgattttttgattgaatgcttaatgtcattgttttgttattattattattattattattattattattattatactttgttatggggtacatgtgcacaacatgcaggtttgttacataggcatacatgtgccatgttggtttgctgcacccataaaagttaattcaagatggattaaagacttaaatgttagacctaaaaccataaaaaccctagaagaaaacctaggcaataccattcaggacataggcatgagcaaagacttcatgactaaacaccaaaagcaatggcaacaaaagcaaaaattgacaaatgggatctaattaaactaaagaccttctgcacagcgaaagaaactaccatcagactgaacaggcaacctacagaatgggagaaaatttttgcaatccatccgtctgacaaagggctaatatccagaatctacaaagaacttcaacaaatttacaagaagaaaaccaaacaaccccatcaaaaagtgggcaaaggatatgaacagacacttctccaaagaagacatttatgcagccaacagacacatgaaaaaatcttcatcatcactggccatcagagaaatgcaaatcaaaaccacaatgggataccttctcacgccagttaaaagggtgatcattaaaaagtcaggaagcaacagatgctggagaggatgtggaaaactaggaacacttttatactgttggtgggagtgtaaattagttcaaccattgtggaagacagtgtggcaatttctcaaggatctagaactggaaataccatttgacccagcaatcccattactgggtatatacccaaaggatgataaatcatgctgctataaagatacatgcacacatatgtttactgcagcactattcacaatagcaaagacttggaaccaacccaaatgttcatcaatgatagactggataaagaaaatgtggcacatacacaccatggaatactacacagtcataaaaaaggatgagttcacatcctttgcaggtacatggttggagctggaaaccatcattctgagcaaactgtcacaaggacagaaaaccaaacaccacatattctcactcaaaggtgggaaatgaacaatgagaacatttggacacagggtggggaacatcacacactggggccttataatttctttcttcatttaggattaaagtcatttttgaagatcatttgcctattctttaaaaattgttttatttagtatgtctttgcacaaggttaattcggtgggttttcttttcttgagatggagtctcactctgtcacccaggctggagtgaagtggtgtgatcatagcttattttaacctcgaactcctgggttcaatcagttctgcctcagcctcctgagtagctaggactataggcacataccactacacccactaattttttaattttttgtagagatgggggtcttgctttgttgcccaggctggtctcaaactcatggcctcaagtgatatgccttggcctcccaaagcactgggttttcttaatcatgttaacaagtattgttttgttttgttttcttcctttccttgttgtttgtctgctgccaccccaacttgaaaagaaactgtcaactgctaatagttagttacactttggttagagggcacggttttctcttcacaccgccataccattaaaaaaaaacagctaagtcccctagcctttgttcaagaataatataaagtgtcagggactgtggacagcacctggtccatagcacatggtgcagtggagcagtggaggtcctccatttcaggacagatagctgctgactgcctttcactctcctacctggagctctctgaagaagactgtccttttccttcaaagactcctctccctccaaatttcccctcactccaactttcccctcactcttcagttgctcctcttcctcctttcttagtcccaaaccccaagccaactttgggaaattgcatgtgattgcatttggttgttatttctgctttgttgtgagttgtgcgtaaaaaaggatctccagcgagagaacagagaataaagcaaattaatacttctgtatataagagctgcttgaaatcctacttttatatactgtctgggaagataattttcctccaagggggaagctactaggtggcgaatgaggaagccaactttatcctgctcagcccatctgaagagcaaaacagtcacagtcgcgttaaagtgatatgtggcagccaacaatgcctccaagctcctctgacactgtcaaatgtaggtttagacttaatatcaagtttcatctagttttaaaaactggaatttagtaaaattattttcaagctttctaaaccacaatttcaggagcagtaccagtttaacaacttttttttccataagttattggggtacaggtggtatttggttacatgagtcatttctttagtggtgatttgtgagattttggtgcacccatcacccgagcagtatacgctgaaccctgtttgtagtcttttatcccttgccccctcccactcttctccctaagtcccccaagtccattgtatcttttttatgcctttgtgtcctcatagcttagctcccaagtatcagtgagagcatacaatgtttgcttttccattcctgagttacttcacttggaataatagtctggtcactgcaaataccattaattcattccattttatgtctgagtagtattccatcatatatatatatagattatatatgtatatatgtgtgtatatatagatatatatgtatatatgtgtatatatagatatatatgtatatatgtatatttatagatatatatgtgtatatatgtatatatatcacagtttctttatccactcgttgattgatgggcatttgaattggttccacaatttggcaattgtgaatggtactgctataaacacgtacgtgcaagtatcttttttgaataatgacttcttttcttctgggtagatcactagtgtgattgctggatcaaatggtagttctacttttagttcttaaggaatctccacactgttttccacagtgactatactagtttacattcccaccagcagtgcagaaacgttccctgatcaccgcatgcatgccaacatctattttttgatttttttcattatggccattcttgcaggagtaagatggtatcacattgtggttttgattttcatttccctgatcattagtgatgttgagcattttttcatgtgtttgttacccatttgtgtatcttcttttgagatttgtctattcatgtccttagcctactttttaatgagattgtttttctcttactgatttgtttgagtttgttgtagattttgaatattagtcctttgtcagatgtatagattgttaagattttctcccactctctgggttgtttgtttactctattgactgttccttttgctacggaaagtgctttagtttaattaggtcccagctatttatcatttttttttatcttttttttttttttttgcattttcttttgggttcttggttatgaaatcctcgcctaagcagacatctggaagggtttttccaatgttatcttctagaatttttataatttcagttcttaggtttaagttcttaattcatcttgagttgatttttgtataaggtgagagatgaggatccagtttcattctcctacatgtgtctagccaattatcccaacaccatttgttgaaaagggtgtccttttgccactttatgtttttgtttgctttgtcgaagatcagttggctatatgtatttgggtttatttctgagtttctctattgtgttccattggtcatctctgtgcctatttttataccagtaccatgctattttggtgactatggctttatactgtagtttgaaatcaggtagtgtgattcctccagatttgttctttttgcttagtcttgctttgactatgtgggctcttttttcattccatatgaattttagaattgtttttttctaattctatgaagaatgatgatagtattttgatggggattgattgaatttttagattgcttttggcagtatggtcattttcacaatattgattctaaccatccatgagcatgggatgtgtttccatttgcttgtatcatctgtggtttctttcagcagcattttatagctttccttgaagaggtctttcgactccttggttagggatattcctaggttttttgttttttgttttttgttttttgtttttgtttttgtttttgtttttgttttttgcagctactgtgaatggagttgagttcttgatttgattctccacttggtcactgttggtgtatggaatacctactgatttgtgtacattaatcttgtatccggaaactttgctgaattcttttatcagttctaggagctttctggaggagtctttagggttttcaaggtaaaggatcacatcgtcagcaaacagtgacagtttcttcctctttaccgatttgaatgccctttatttcattcttttgtctgattgctctggctaggacttccagtactatgttgaaaaggagtggtggaagtgggcatccttgtcttgttccagttctcagaaggaatgctttcaacttctccattcagtattatgttggctgtgagactgtcatagatggcttatattacattaaggtatgttccttgtatgctgattttgctgagagttttaatcataaagggatgctggagtttgttgaatgctctttcagcatctattgagatgatcatgtaatttttgtttttaattctgcttatgtgtggtgtatcacatttattgacttgcatatgttaaagcatccctgcatccctagtatgaaacccactttattgtggtagattatccttttgatatgttgttggatttggttactagtgttttgttaaggattttatcatctgtgttctttaggatatcggtctgtagttttctattttggttatgtccctccctagttttggtattagggtgatgctggctttgtagaatgaattagggagggctcctttctttatcttgtggaatagtgtcaaagggttggtaccaattcttctttgaatgtctagtagaattttgctgtaaatccatctggtcctcgacttttttgttagtaattctttaattactatttgaatcttgctgcttgttattcgtctcttcagggtatctaattcttcttgatttaagctaggaggtttgtattttcccaaaaatttatccacctcttttaggttttctagttcatgtgtgtaaaggtgttcatagtagctttgaataatcttttgtatttcagtagtgtcagttgtaatatcttctgtttcatttcttagtgaggttaaatggattttctctcttcttggttaatcttgctaatggtctatcaattttattcatctattcaaagaaccagctttttgtttcatttatctcttgtatttgtttgtttctttgtttcaatttcctttagttctgctctgatcttggttatttctcttcttctgctgggtttggatttggtttcttcttgtgtctctagttcttggaggtatgaccttagaatgtcagtttttgctcattcagtcttctgtaggggtttacggctctgaactttcctcttagcgctgcctttgctgtatcccagaggttttggtaggttgtgttgttattgtcattcagtctgaagaattttttttgtttttttgagacggagtctcattctgtcaccaggctggagtgcagtggcacgatcttggctcactgcaacctccgcctcctggattcaagcaattttcctgtctcagtctcctgagtagctgggactacaggtgcatgctaccacaccaagctaatttttgtatttttagtagagatggggtttcaccatgttggccaggatgtactcgatctcctgaccttgtgatctgcccacctcggcctcccaaagtgctgggattacaagtgtgagccaccacgcccggcccagtctgaagaatttttaaatttccgtcttgatttcctttattgacccaatgctcattcaggagcaagttatttaatttccatttatttgcatggtttaaagattccttttagagttgatttccagttttattccacggtggtctgagagagtgctcgatataatttcaattttcttaaatttgttgagtcttgttttatgacctatcacatggtctatcttagggaaagctccatgcgctgttgaatagaatgtgtattctgtggttgttggatgaaatggcctgtatatatctgttaagtccatttgttccaaagtatagtttaaatccattgatcctttgttggctttctgtcttgatgacctgtccagtgcagacagtggagtactgaagtcccccactattattgtgttgctgtctgtctcattttttaggtctaattgtgttataaatgtgggagctccattgttaggtgatatgtttacaattgtgatattttcctgttggacaaggccttttaccattatataatgtccctctttgtctcttttaaatgctggtgctttaaagtttgttttgtctgatataagaataactatccctgctcacttttggtgtctatttgcatgaaacgcctttttccacccctttaagtttatgtgaggccttatgtgttaggtgagtctcctaaggcagcagatggttggtgagttcttatccattctgctgttctgtatcttttaaatggagcatttaggtcatttgcagtcaatgttgaaatgtgaggtaccattgcattcatcatgctctgtgctgcctgtatactttggtttttttgtttttggtttttaacttgtatttttgttttataagtcctgtgtgatttgtgctttaaaaaagttatcttttgatgtttccaggatatgtttcaatatttagagctccttttagcaatttttgtagtggtggcttggtaacggcgaattctctcagcatttgtttgtctgaaaatgactgtatctttccttcctatataatgcttagttttgctagatacaaattcttggctgataattgttttgtttgaggaggctaaagatagggccccaatcccttctagcttgtaattcttctgctgggaaatctgctgttaatctgataggttttcccttataggttacctcgtgcttctgtctcacagctcttaagattcttatcttcgtcttaacttttgataacctgatgacaatgtgcccaggcaatgattgtgatgaatttcccaggtattctttgtgcttcttatatttggatgtctaggtctgtagcaaggccagggaagttttccttaattattcccccaaatatgttttccaagcttttagaattctcttcttcctcaggatcaccaatttatcttaggtttggtcgtttaatataatccgagacttcttggaggctttgttcaatttttcttattctttgttctttgtctttgttgaattgtattaattcgaagacgttgtcttcaagctctgaatttctttcttctatttgttcaagtctattgctgagactttccagagcatttcgcatttctttaagtgtatccaaagtttcttgaagcttttactgttttttcctttaagctatctatttccttgagtatttctcccttcacttcttatactgttttttggatttccttgcattgggctttggctttctatggtgcctccctgactagcttaataactaacctcctgggttctttttcaggtaaatcagggatttctttctggtttgaatccattgctagtgtactaatgtgatttttgggggatgttaaagaacttgattttgtcatattaccagggctggttttctgatttcttctcatttggataggctctgtcaaagggaaggtctagggctgaaggctgttgttcagattcttttgtcccatagggtgttcccttgatgtagtactctcccccttttcctatggatatggcttcctgtgagccgaactgctgtgattgttgtctctcttctgggtctagccacccagtgagtctccccagctctgggctggtactgggggttgtctcacagagtcctgtgatgtgaaccatctacaggtctctcacctgtggataccagcaccagttccaataggggaggtggtggagggtgaggtgcaatggactccgtgaagtttcttagctttggtggtttaatactctattttgtgctagttggccttctgccaagaggtggcagtttccagagagcatcagctgtaatagtatggagaggaactggtggtggacagggctctagaatgaccaagattatatgccctttgtcttcagctaccagagtaggtagggaaagaccatcaggtggggacagggctaggtgtggttgagttcagactgtccttgggcaggtcttgctgaagctactgtggggaatggggatgggattctcaggtgcctggagctgtgtacctaggaggattatggctgcctctactgggtcatgaaggttgtcaaggaagtgggggaaagccagcagtcacagaccttacccagctcccacgcaaaccaaaggaccagtctcactcccaccgtgacccccatgctagccctgagtctttccaggccatgggcgagatgggcttgaaaacttgccccaggctacctgcctcccaactgtgaaagaaaacgacttggctcttcccccagttgtggaatctgcacaccagatttgcaccctcccccaagttctggccaggaggcttcttgccccttcaaattgttacaaagttcagcaagagaggcttcttcctgtgcaattttaccccctgctcctcttgccaccctccctatggatccctgtggtgccaggccagaatgggctgctcgaggacccagcaaactcccagggcctttctgctgcttcctctacccctgtatttcgctcagctctgtaaattgactcagctctaggtaaggttggaaacttctcccacaaacacaccttcagttcctccagtgggggtatatattcagcagaggagggtctccgtttcacaattccacagttgaggcactcacagtatttggggtgtctcccgggtcctgcaggggcagtctgcttccttcagagggtctttgggtcctctcaggattgcgggtttgttcttgtagtcaatatgaagcttaaattcacatcacgagctctgcagtcttctctgtccggagttgcaatctagtcctgcctcccaaccgccatgatgatccagcctacaacttcttaattaattaattcttattgctggttcatagtctgtcagaagtttaggtagtattatcatttagatgtactactttgcacacatagttaaaatatcttagctcttcaaacattcgtcatgaaacatgattgcactcttctgaagtgacagtattcatcatatcctccccacatcctcctgaactaggctctcgggagttcatagcaagtgttcactcttaatatatatgtctgctagaactgatcagggaatctaacaatatggaaagccaccttctcagtcttacatctaactttatttctctacagtagtggttctcaacatggattatgctttgcaagcacctggggaactttaaaaaaaatctcaatacccaggctgcatctcaggttgattcaaatctctggaagcagaccaaggcattagtactttttaagtctcctcccttcgttccaatgtgcagttccagttgggaattgcttttagcgcatgccaggttactaatttctgagtgttgattaagggaacatccgagctcatcatttctcttgtgggaattttttgagaagcaagagagattggggaacaaaatagctactgttttttgctagtgcaaagagcttagcttaaaatcacacagacctatgttttaatcccatctttgctactacaggaatgtaaagatgggaaactcacttatctcccctgcagtttcacccatttctaaattgaaataacatccaccttctggagtcagtattaaatgagatcatatgtgcaaagtgttcaacatgatgtagtatgtaacatgataggacatagtaataataactaaagatatcactacaaatcaaaatccttattttcaaaattaagtctccaaagaggaaatgaaaatgaatcccaaatctgttgcctagatttttgagtgccaagcagcattaatgctaatatttcttcagcattatcactaagagaaatgagtgttccaacttaactcattgttcttagtgataattcatttagggacaaaattaggctctcctgttaattgccacattcctttcagaggtgctataaatggatgttgaactatactatttttagatttaatctttaaaaatcataagaaagcaataaatattactagttcagaaatgattttctgttcctggcttatcagagaagacctgagagtctatcatagtcatttgttgtcttcatagtgaaacgaaaaagtaagattctaataggatttttagacttagtgagaaaggtgttcattttaagattatggtagttcctctcagatttggaaagccttaagataacactaaggagttggactttaggaatgctgagtgtcttcagccacaatggcactatagtactagatgggacaggatgtgattaaggagaaactaagcagccagccacaatgtagttcttcttgcctccaaaagaggagttactcactttctcacactcactgtgatacattccatttgctaagaaaagtggcttgtgtcattcttgtgcactacttttaagttctgatatattagattcatttactctgtattaatagcattcaaatatttagtaaagttaatatacttctcacactttttccaaattaacccaccagctgtgtcctgtgcttaacgctatcttacaacactgcagtcaaagtgtcagccagggctgtggtctcatctgaaggctggatagggaaaaattggctcccatgttcacttacatggttgttgccaggattcatttcctcaagggttttgattctgagggcctctgcttcttgctaagtgttggccagaggccatgcttagttctttgctgtgtggttctcaccaaacagcaacttacttcatcaaaccagcaggagggtgagtctgctagttaaaaagaagtctcaatcttttgtaacctaatcatagaactgacatgcgctccatgctaccatattcttttgattagaagcaagttactcaagggaaggaaacacataaggctgtgaatgagagaagacaggaattgctggaggccactttaggggctgtctgccacagcacttaacagcacattcccctagccataaaatttaaaaaagcaggaaagagagaaggagggtgcagggtaaaatacagaaaggaggaaggtgaaagggaagaaaggaagggaaagaaagacatttaaaaagacaagaacaaaacagctctgctgcactacatctatgtagtagtgtagtggagagttccatgtgcagacacacacttcatcacattagcaccacacccataaatttcctatttcttatttacaatgagaagattataaggactttctatgcatctggagttaaaaggaagcaataaatctaagaacactaagtttaagtaagcaaaatgtgtttcaaattagttattttttctttttaagttttttgtttgtttgtttcagctgacaaagttttttatttctttctgtttcaagttttcaagttgagtttataattcttgctattatgtaacaggtctattatacaggcaatataggaacctgattggcattcgtatttggtgttctattgttgtttcaactcaaatgccaaaattatgtttttgttctgtacgttattgttcatagttatatatgccccttaattgtaaaagtgaagctgtaaaattgtaaactactttgtaccttatctatccaggcattctactaaggaaatcaagacccaaatggcttgggaagatcaacattaaatagcgtcagagccagaccgagagtatacatctctcaattgctaatctagtgcatttgcttttcttatttctgtgcaaatgaacagttagaatgtgaaatagtctcctcagatctgccagcattaaaacagttgtggtttaagtatttagttttaataattactaactttgtagaagaacctaaaatagtgtttgttttcagtgcttcagctaatagtaaaaaggagtattttcagtactttactgtatgagaggtgcttgcctaacaaaatacacatctttttcactgtactcatttgtaacagataatgtgggctccgacacctcagtgttctgagaggggttggtaaacgctgaccacatagagagagctgcccatctgccctcagtaccaaggcacatcccatccatgccctaaaactcttgtaaatttctccattcgtacaggaaaatgagtatttcttacaacaatatgaccgtggaatttgattacaaaaacattcctgctatccccaacatgtgctcccagggctaaagacataatctgcaactcaggattttctgaagattcacttgtttatactattgagggcaacagttgtttttaaacaaggatgcggttcccagtcctatactttcttcttaccctgcttatttttctttttttattattatactttaagttctgaggtacatgtgcagaacgtgcacatgttacataggtctacatgtgccatggtggtttgctgcacccatcaacccggcatctacattaggtatttctcctaatgttatccctcccctagccccacagcccctcaacaggccccagtgtgtaaagttcccctccctgtgtagatgtgttctcattgttcaactcccacttataagtgagaacatgcagtgtttggttgtctgttcttgtgttcgtttgctgagaatgatggtttgcagcttcatccatgtccctgcaaaggacgtgaacacatccttttttatggctgcatagtattccatagtgtatatgtgccacattttctttatccagtgtatcattgatgggcatctgggttggttccaaatctttgctattgtgaacagtgccacaataaacatacatgtgcacgtgtctttatattagaatgatttataatcctttggatatatacccagtaatgggattgctgggtcaaatggtatttctagttctagatccttgaggaatcgccacactgtcttccacaatggttgaactaatttacactcccacaaacagtgtaaaagcgttcctatttctccacatcctctccagcatctgttgtttcctgactttttaatgatcgccattctaactgatgtgagatggtatctcactgtggttttgatttgcatttctctgatgaccagtgatgatgagcattttttcatgtgtctgttggctgcataaatgtcttctttggagaagtgtctgttcatatcctttgcccactttttgatggggttggtttttttttttttttccttgtaaatttgttgaagttctttgtagattctggatattagccctttgtcagatgaatagattgcaataattttctcccattctgtaggttgcctgttcactctgatgatagtttcttttgctatgcagaatctctttagtttaattagatcctatttgtcaattttggcttttgatgccattgcttttggtgtttgtcatgaagtctttgcccatgcctatgtcctgaatggtattgcctaggttttcttctagggtttttatggttttaggtctaacatttaagtctttaatccatcttgagttaatttttgtatatggtgtaaggaagggatccagtttcagctttctgcatatggctagccagttttcccaacaccatttattaaacagggaatcctttccccattgcttgttttgtcaggtttgtcagatggtttgtcaggtttgtcagatggttgtggatgtgtgatgttatttctgaggcccctgttctgttccattggtctatatatcttatttggtaccagtaccatgttgtctttgttactgtagctttgtagtatagtttgaagtcagagacacaatagaaaaagaaaattttaggccaatatctctgatgaacatcaatgcaaaaatcctcaatacaatactggcaaactgaatccagcagcacatcaaaaagtttatccaccctgatcaagtcagcttcatcgctgggatgcagggctggttcaacatacacaaatcagtaaacgtagtccatcacataaaccgaaccaatgatgaaaccacatgattatctcagtagatgcaggaaaggccttcaacaatattcaacagcctttcatgctaaaaactctcaataaactaggtattgatgaaacatatctcaaaataataagagctattcatgacaaacccacagccaaaatcatactgaatgggcaaaaactggaaacattccctttgaaaaccagcagaagacaaggatgccctctctcaccactccttttcaacatagtattcgaagctttggccagggcaatcagacgagaaataaataaagggtattcaattaggaaaagaggaactcaaattgtccctgtttgcagatggcatgattgtatatttagaaaaccccatcatgtcagcccaaaatctccttaagctgataagcaacttcagcaaagtctcaggatatgatatcaatgtgcaaaaatcacaagcattcctatacgccagtgacagacaaacagagagccaagtcacgagcaaactcccattcacaattgctacaaagagaataaaatgcctaggaatccaacttacaaaggatgtgaaggacctcttcaaggagaactacaaaccactgctcaaggaaataagagaggacacaaacacatggaaaaatatcctcatggataggaagaatcaatatcatgaaaatggccatattgcccaaagtaatttatagactcaacgctatccccatcaaactagcattgactttcttcacagaattggaaaagaactactttagatttcatatggaaccaaaactgagcctgcatagccaagacaatcctaagcaaaaagaacaaagctggaggcatcacgctacctgacccagcttatttttctacataggatccccacatccctgcctttgttagaatggaaactagacaaggaccaacttttatcaacttgttcatttctctattcctagaacagagcctggtacaaaatttgtgtttaataatgtttgttgaatgaatctgaatgatggatttgtttagaaggtttgtaacattccatcccttatgagtttgttgctagtggaaaaaagaggcatgtttttggttcataacatcaggtatgtaacctggaatttggaatcatgagttttcatgcatttgcttcatattatttatttttaagtgatctttcaaagtattgataaagatactttaagattgagagcctccctgatacccaggaatgaaagttttagattaagtttacaatctgattgaaggctaatcatataaggagaaaaaaaataaggaaaagaacagaaatttggaaagaaatctccaaaatggccatgaacatcagaacactgagaatcgatatataaacatgtgttttgcttcatacctgtctgttgtacatctatagcagcagatttcatagatgcagaggaattttggctaaaatcctaacacataaaaggcattctgcacttacttctcaaattagaattaatacatgtgtatgtataagttgtttagaattggcatctatttaatgagtttactggctgaatcttttaaaagaatgcaaacatacgtgacttttatcaaaaatctatgaaaagaaaaatggccctgtagtgcatcctgtggttcccactctacatcccccacgtccacctgatgtcagcacaaccatctgtggcatccattggccactatgccagtcaggtgcacactcaggtgcctgcctcggcaaagaccctcagctcatgtgcaggtagagcctagaagtgcatggaggtgaacatctctgaggcacccttcaaccagtgggtactgggagtgatagataaatgtcctagcctctcatctttctacacaacaatgctggtgcatattctacacagtagctcagtaacacacgcatattagttgttctccctttccttcccaccctccccattccctcactgctacatctggaagccagatgaactgcctatatccaaattctaatctctagctctcgtttcttaaacaggtcctacaaaatgcttgaaataaaaggcaaaatggtttgtatctggaatcaaaggctgacaatggcaagcaacaagctctaaaactgacacaggaaaaatgcttttctggaagacattggcatcacctcctagacacggaatatgctggcttcatcccagtagtttcttcacacacttttaaatacgtgtctcattaggatcacatatgacccacctgatttcatgccttgccttttctttttattctgcagactcttctaaggagcctaaattcaccaagtgtcgttcacctgagcgagagactttttcatgccactggacagatgcggttcatcatggttcaaagagcctaggacccatacagctgttctataccagaaggtgctgccctcatgcctttccaattttcctctccatggatatacctactaaagtacactgaatcacatatagtgtgggaatagaagtgatttgttgtgatttatgtaatctatgaatattcattcactcatttactgaaaaaaatattaattaagcctatcctatgtgctgagtactattttaggccctggagatatagcagtgattacaaaagacaaaatccctggtctcatggagatttccttccaatgcagggagacaggcaataaaaattgaataaaatgtcaactagtaatataggttattaagaaaaataaagccagaaagcagcatatcagcagtgtttgggagtttgtgtgtgtgcatgagaatgtatgagagtgtgtcaaagtatgagtgagagtgtgtatgggtacacgtgggcatgtgcctgtggatgagagtgtgtataagaggcttgagtgatattgaaatgggtgatcctaggaggcctctctattgtggtgtcctacaccagagacataagtgaaatggaacaggtcacgtgaatatctgggggaaaggctatccaggcagaggaaattgcaagtacaaagtccctgaggcagtcttggcctattcaaggaatgaaaaaggccagcactgaaggcacaagattgaaagtgaggagagtgatatgggaagagatcagagagttacttagggactgactatgccaaacctcgtagacaagggcaaggctttaaattttactttatttgtggtggaaagctataggtgtttttgaaaagatgcatgttttaaaagatgtagcttggtttctaaccagataatacactccttctcttaaatatattcagtaaaagactgtagtactttttcatttttaccagtgatcctctaaaataacagaggcagggtgaaacaaacacctctcaatataggtaccacccaagttgtttatttcttccccttcacctggcattatttttgtttttggtttactcttactctgtatatttttaccttttatacattttaggcttaaacacttcattatctcttcttttccacccaacccccagagaatgcctaagccaagatgcaggcttagtgaggaccctttatccttggctcaaggtgttcgttagtcggaggatgatattgtctatcccacggaagagctgggaaagggaaggaagatgcagccaacagttaagggtatgaactcagggccaacaaacctgcacttcagtgtacttctgcactttctctcttttttttttttgagacggagtctcgctctgtcgcccgggctggagtgcagtggccggatctcagctcactgcaagctccgcctcccgggtttacgccattctcctgcctcagcctcctgtgtagctgggactacaggcgcccgccacctcgcccggctagttttttgtgttttttagtagagacggggtttcaccgtgttagccaggatggtcttgatctcctgacctcgtgatccgcccgtctcggcctcccaaagtgctgggattacaggcttgagccacggcgcccggccaaggaatactcgggaaattagccagtttgtgtacaactcagcctcctcatttgcagaaaggagataacggacttgcctcgtggcttcttgtgaggatcgtatgagataacccatgaaaaatacttggcagagtacttgacacataataagtactcagcaaattgtagctgatattcttattatcggtagtatagtgataatttaaaaataattatgatatagcaatccagttcctggactataaagatgactataagtggtataagaccatttataccaataaattgttataattattggtataagaccattttaatgcagagctgctgcttaatttgcagataaaaaaatacttggagttagcaaccaagtggaccttccccacctttcagtgtaagagaggtctcttggatgaagtgaagtgaagatgaaatgtttgggcaccaattatactatatttttccttaaggctgacaccacaaagaggttggggcctgtaaacaaagttgatttctataaacacattcggacatgaagttagtatgtttgatgacacttttgaaatgtgtggaatcgttatgttatttgtgcaggcacaattagccaaactgtaaagaaaattagcagaataacctcttaagctgggcccactttatgaaaataattttttgctacctcagtatttaccaaatttgaatataagcaaaaagagaaatcgaaaggaatgaagccttgataaatatatgtcccttgccctcatcaatcagcgtcacataactgtttccacaggcatcttatgcacaccccagtcatttcagcatccctggttcaaatccagcatctacactaccaaggatgctgctgaaagtgtgactgggtagagggaaaatttcagacatattcagaaagatgtcttagattttaccctgatagtgtttggaatcccaggagagtaagtacaacttcatgattaagtgccaacccaaacttacaaaattagatatttgtgttttttctataaaatataactattttgaatatcttagccaaactactatgagcccacagcccagtttatcgaagaagggtaaaactgagggattaggagtatcaggattggactggactgattagtgtacagatatatttgacttctcattgcccacttcacaaagaagacaatacaaatgcactttctgactcttgtcattgtttcttagaactcagttgccaggcaactcctgaaactatagaaacatgcttcgcatccctgacacataaataaaactgtggattttatccaaaaccagagtcagtgggaggtgcagttgtttcagtttgctggcctggcctgtctaaagcacaatggaatgtgaacatgtcaggctgtcaacacgacatttcaggcacagccctacaggcagttgtgtgttttgcgtggctctgctccttgccaggtagctggcagaagaggcagcctccacatgttaaagcagctgattcaaaacagtctctgccatcctgtgatggcgatagtgccaaactcagcctctgagcttgcaggggactcgggatgaatgcacattacaggcatggcaaaaggaggctctgagaagcatgttcgagctgctctgctctcagctccttgcatgtaaaagctgtatttttaaaggaactgggcatgtgaacactcagtccttaaagttgtatccctcacctcttccatacccattcaaccccacttcaaaaattaccctagtcttaagagaaattttattttctatacaaggttgtgtggaaaatcagtagggagaaagggcattattactttcatttttcttaaacaaaagtattgaatttaaagccaaaaacatgtgagctttctgtcatgaaaacagctgcccttaaaaacataaatgaggttttatttttattattttttccagttggttgtctttagatgaaaaacatttcttctgctctttattcttatttttaatgatagtctctttctatggttctcaccccttccatttcacaagatagtctggcagcaaacctaaagcacttaacttttgggagtaagagcaaagggtagcttccatgaattgatttgggtcttctgtagagacattcaacccagagaaggcaagtgacacagtatctgttttatgagctaatttgggttcttgtctacatttaatagtttaaaatataagttataaatatttatttaaagcgaaattcaacattggttcatgaagaaagaggttggaagcagtgttttgaactagctgtttctgatccatcatgcttaaaataaatgctttgtttgtcctgtggagttcatggatttgggataatctaaacagggttttttacacagtcctcatggggaccaaggtactgacatgcactgttgagaaattctgtgaatcatgaaagagttaatattttagaaatccagacctgttgagcactatctacatctttgggacgtcttaatactttgagttttctaactttcatactatcacttatgctaagtacatttgatatcccttctattatgtgaaagcttcattttctgggcaatcttcttacaactactctttttaatgcactcttacttagtttgaaagtaaatgtcaaattaagcatactatagttcaatgaaggacccacctattcctaatttttttaagcatttttcttctgactctacatacacacatgcttacacacgcacaaacatacacacacacacccccttatcttttcttctgccttttgcccacttactttttgcatcagagatgaatctcattcaagcacatgccagttgttttttgttgttgttgttgtttttgagatggagtcttgctttgtcgcccaggctggagtgcagtggcacgatcttgactcactgcgacctttgcctcctgggttcaagcaattctcctgcctcagcctacctactgaatagctgggattgcaggagcatgccatcacatccagctaatttttgtatttttagtacagacagggttttaccatgttagccaggctggtctcaaactgctaacctcatgatccacctgcctcagcctcccaaagtgctgggattacaggcatgaaccaccgtacccagccagcatatgcaacttttaagagtctcaaccaaagcagcaattcactatctcagcccctggagtctctgccatttaaatcccaatttccttccaacagctgaggagcagccgtctcaagtaccccctgatactacacaagttttctcctagtgccaagcagaccagcctgagaaacagctataagaaggaaataggcatcttctcccagctttgcatcccttccttccaggtcctgccttccttacagcctgcaatgtcctcattgtccactgctgcccagcacccatcccacagagggatggtcccaaacctccacagtctggcctgtgagccacaggagcctctggctgcacaggccattcctacctcatcttccacaaccacagattacgtggttttatgtccctttgacttataaattatcttctcaattaataggctagtgaataacaggggataatgaactacctcacccaagtagcaattctaatttaagaaaactttcctgtcattccattgccttttgcttcccttaccacactcatgcccatacttccttacctcaatccctctgacctctcagtttcctcccttccttgccatattgccatctattaaacttttacccatccttcaagaatgctaaaaatacacctccaccttgaagccttccatgaagagccacagcaatcattccctcttctgaacttttaaggaccctagagagcactactaatgagcacttacccacattgctttgtaataccattttttactctttccttctgaggcaggaggaattccttagacatctatgaatcccccatagtgtctgtcattatgtttcagacataaccaattctcattaaatatcaatgtaatgaatataagaggcccaaaaaactactcagatgggaatttgagtcttattttagcctgaaattaggggaccacaacttacttatctttatatctacacagtgttggtgctggatgtaatgcatcactctgcccggagcacacatcaacttgtctcctcagtttctttcaccataggctgggaaaacagccaggtctaaactttcactgttctctgggactctctagtttggggtgattctctgtactgttttaatgaacatttttaaaatgtccctaagtctcagaaccttcatctataaaatgggcataataaagtacctaccataggaatcaatttatgaccaggcatagcatatacattcaataaacggaaggttttaccataggcagaaacaccaaatggcctcttagcagtcttcagacactgatgatattgtccaccaatgtgatatgtcttggaaatggtgttgctaaaacacctcttcacaaaatatttgtgttccaatttattgaatcagactatcaagcaccttacttggacttcagctacaacatgatttttggaacaattaatcttttttaatcctccattttaggaatattcaaggacagactcaagaatggaaagaatgccctgattatgtttctgctggggaaaacagctgttactttaattcatcatttacctccgtctggataccttattgtatcaagctaactagcaatggtgatacagtggatggaaagtgtttctctgttgacgaaataggtaaatcacaggtttttgtttcatttgacatagttttacactaaataaatggggaagcctgcaaggtccaagtataatcaagtaggaagacttagtaacagtgttctatagatacgtggagatctgttttacaggagatgggatcagctggtgaacaagaggaaaagggcagggggaacttaagttgactttaacataaagtaacctggcagtaaatgatgtgaagaaaagaataggaaccttgtggagtcttttcctttaggatatctttgaagctgtgttgtgttcttatgttctattgcaaagggtaaacttaatatattcttaggatttcttacttcctaattatttgataggatgcttatattcagattcactgaaatacgttggcctttgacctctaccattgctataatcaaagcctagattttctttatcacaaagcataatcattctggaattttacatttacaaaacagccacagtcactttaaagacatgtttataagatctcagaacaaatactggagacagttagctcagtgaactaagtgaaagatccaaagagaggatcctttgcccatcatatggacacaaggtggaaacaaaacaaataaaacaaacaactataattagaatattcatgtttataccttaatagtataaacagcaaaatagaaagaatcaaagaaggacattgagtagctgaaattggtgcctcaaaatctatccacaaaagctaatttgttgcttataggaattcctcattgcttctcccaaatgtgttgttcttttatgtggttttctaggcataagctgactggaagagataggagtatgtggttagaagttacagatggaaacaaataaaatctaataggctgactttaagggagaagattaagagacctgtatcaagcagtaaagataacccaattgctttgcaaagacaatttagtatgtgtccttaacatcagtggtatagctgttgagctgaaactaaatgggatagcagaatgggatagtagcaagaatactgggttaaaacccatgttctaactctgttctctgccaatagcatatgaccagtcctactcatttacctggctgactttcactgaacacctgtcatgtgccaggcactgttctggtggtggtggtggttatagaataagtacgatacagtcgaagaagggagtcaggcatgttcacagataattgcagtgcagtgtgagaggttttagcctggaaatatgtggaatgcacagctgcaaaggtggccaaatgtgtgaatgattgacaggcctgagggatgaggaagggctgcacagagatggtgacagtttagttacctctgaactggaattggactctccctattttttaaaaagtggctacccacagtggtcaaaagcatgagtgagtgttgccaggtactgcagtggacttgcctttcagtaactactaagttccagcagtaacaaatagcacatgttcagggactcaggagcagttagaaagccctcctagtcagctggagaaatcatcagtagttgttcgtgccccaaaaaggaatttggagtttaactgtcacaaggtacctttgaggatgtttaaatagggaaatgacttgagaatagtaacagctaacagtcacaaaagacttaccacgtgtcaggtataaaaaccatcttttgcaatcgcactttacagataatgaaaccgaggcgcagggcatttaaaggactagttcaagtaaaacagctagtaggtagagctgggatttgaacctccagcctccatgcttttactcttgaggctttgcagtaccacttgtctcattatcaatgcctcagagaaattaatcttattgcaatgtgaaacatagattggagtgggacagactaaaggtagaagaggttagaagactgagatcatcaaggtaaaagattatgacaggcagctacaactagcacaatagttgtgggagaaggtgctgagagtgaaagaaaacaaagaactaaggtaaccctaatagatcttgagaaagttgtcaatcattataagcctcagcttcctcataaaatatgtatgtatggtactacctcacagggctgttctttggatttaaagtactgtattagttagacatttgtcattcattcaattcattcagcaaatatttattatgttcttttctcaggccagtcagtgttctccatactggggatagaaactgtcttccctggtgggatctaatcccagcgagggcggaaagtgacaatgctatggagaaatatagaaaaggagaataggagtgttgaagaggttgcagtgttgagttttcaggattggcatccctgagtcagtggcatttgaataaagaaggattagagaggataataatgtgtgtgtctcagggaagggcatttcagcaaaggggcacagccagaggaaagatctcaaagtagaagcatgcttttcctcactcagtgaacagcaggcaggcggtggggtgggcacagagtgagcgaggagactggtatgagaccaaatgccacagacaagacagtcaaatctacccaaccattgtaatgactttggctttcacttggagtgaggtaggaagcctttggagggttttagatgatgagtgatgtgatctaatgtgttaggataatcactgcgtcatttcacttgacgattgcatggagaatagactggagggggacaaagaccaaaggagtacagtggggagacaaatgcagcaagaagaatgaaaaaggataatggctaggaccaggttatagtggtgcaggcggtgagacatggttggattctgttatatcttgaaagtacagctgatggaatatggattagtgaggcaaaaatgagccaaggacgagttcattgtttttatcctgagcaactagaggaattgagtcctcattaacagagatgggaaagaggaaaggagagcaggttttggagaggaagagcaaaggtttgtttggggatatactaagtttcagatatttttaaaatatctcacaggaattgtcaatacagcatgtagatgtatgtgtagaggtaaaggagaggtcattattatgcctgtaatggtgataccaagccttttccaaaaggaccttgtctcatatcctctatttttcaaatgtagcgtaagtaataagttataaaaaaaatcttccattaaaaccagttttatagtttggtcactttaaagggttgagctttgattatcaggattcctgaatctccaacaaatccagaaagttgaggaattactgccattgtatcggcatatgtagtttggccattttgcatatccttccaatttaattttcaaaatgtagtcatgattcatcaaattttgactctccctgtttttaaaaaggtggtgtcgaccccagagggcaacagcattctcctccaccataaagcctgttttcatgtgggtgcacacaagagcttccctctttggccaccagatttgacagtcagtaagagctcctcactgtgtgtatctgtagagttatctccagtcaaccctagggatgcacactttgcaacactctaggtggccttctgtatatgacagaaaaactagcaataatttaccgggaaccatctagaatataaatttagacatagtttctggctttgaaatccatatttttcttcatcagcctttgagaaattgtggtctttgaggtcctaataagcagaatgcaacaaattttcctgggactgtagagtatatcagtagaacctgaggaaaacagtgtttcaagttgttcatgtgacagttaagaaaaagacagaaaacactgaatcgtcaccatttatgagactagcataatgccttcttccttcttatgtcagaagaaaacatcacatgtggctaggaagaccacaaagctagggagcgttagcagcgtgtgcaggaagatcgtatgagaagattgaagaagagtgaaaaaggataatggctaggaccaggttatagtggtgcaagcggtgagacatggttggattctgttatatcttgaaagtacagctgacagaatacggattagtgaggcaaagatgagcctttcggggaacaacacagaaatgagataaatgaggtatctgcccccaggccatacatagttgcaagaaaaaagatttctctacccctagttccacagcagcctcatgtctcaattccgtaggtttttctgactctgttttttcagtttcaagcgaaaatgaattcatttgccaaaatccagatgcatttatgatatcagagcaaaaagaaatataaaacatggcagatcttgaaaatattttttggcagattttttgctcccaaaggaatttttgtaagggcttatttaaaagttaaaaacaagtcacttttgcgttaaaaaaagttactctcttataaagtgaaagttataataagaaaaatattggaagaaataagagtatgaacgatcaaaaatatagaaagtaatttggtcttctgagaagaatgccttccattaataataaattgtgtctgtctgtgtactaatgctctgttgaattgcacagtgcaaccagatccacccattgccctcaactggactttactgaacgtcagtttaactgggattcatgcagatattcaagtgagatgggaagcaccacccaatgcagatattcagaaaggatggatggttctggagtatgaacttcaatacaaagaagtaaatgaaactaaatggaaaatggtaagatgtcactacaccttacactttgacttttctttctatttcatcaacctctctctcatttatcattagactttcttttgacctaataccacatgttcatgctgtatgcgccataatttcttatttgagaaaacatgatttaatcggtaaaatatcttgaaattctgttaagacaggagatgcttatgtatatatggaggcctgtggaaggaaaggaaaactatttctccattcattcttgaggtccagtttaactttagagtaaaattatagactggccacttatctgtctttggggatgtggataaaaatggaaaagtttgtgatcaaagtcaacagtgactatggccaaatattttcccatgatttcagttgctgctactcaaaagactcccattaaaacaaattcatacgtgtttacaggaaacagaggaagggaatttgtctcttagaggtttcagaaggatgttttgttacatacctcagagaagaatcaagctgagattctcacgtaggcaattagagagcatggtactggttaacctctgaatccctctcttccttaccaagcatatggaactcagcacttcgataaaattcacatggcacataacaagaggaaaaacaggagtatcatgctgctcccaatataactaattctaaatctgtctaaccacagccacaggcacagccaaaccaagcagtttctggccactcatcaggtgatgcccagcagcctggcacagatcactcccagaattttgagacaccaggacattcagtgaaccactgaaaaagatgccaattttgtcattagagggaagttaagtttggagatactttgagtagttgcaatactggactttggggctctattttctgaatcattttaatgtagatatctgttctgtaacttggtacaaataaaagtcctggttagatgctaagtcaaacaagactgtctacatccaagctacaatcaaacattattcagcaacaggtactgaaataactactatgcagaaggcactgtgctaaatacctgaggtggcggttctcaaagtgggaaccacagacccctgagggtccctgagaccctttcagagagttcagtactattttcacaatacactaaaatgttattttattcactatgctgaaatttaatttaatggcacaaaagcaatgctggaaacactgctggcaccttagcatgaagcaaggcggtaggatcaaattttactaatagtcattatattcttcatcatcatgcactgacagtaaagaagggggaaaaagctagtttcatgtatgatgttcttgatgaagctgtaaaaattgttaattttgctaaacctcaacctttgagtacatagcttattaatattctgtgtgacatatgggaattacacattaagcatgtctgctgcatactgaggtattgtatttgtcttgaagaaaagcgcttaaatgactgagctgccagctgaactagttgcttttattgcttggagcaccatttttacttggaagacaactgataaactggcagatggttattcatatttgaattggcaaacatttctcaaaaaagaatgaggtgagcttgttgcttcaagaaaaacaactgactgtattttttgccatggaaaaaatttgacttttcaaagcaattcattttgcctttttggaaaatttgggtctccaaccgtgagcttgatagtgttttaatatttgaagacttttcttgaagagattcatggtgatattaatgaaagtgattttttagttgtattgtgtaataaaatgtatgaaatttagaaaaatctacaagtcagtgaaccaatattttccaaatgactaatatattatgtaattaaatcatgcatggggaaatgatccattaaaagtactagatagaatggtgaatttttttaatgatcaaaaaattttttgtatatttattgtgtacaactttttttgaaatatggatacattgtagaatggttctatcacagtaagtaacatgcattaccacacacaccattttttgtgtgtattgagaacactgaaaatctactcacttagagattttcaaaatacaatacataggcattaactatagtcattattttgtacaatagatttcttaaactcgttcctactaactgaaaattttagttctttcgtcaatatctcctcaactctccaccctacccacaacccctgataaccaccattcaactctctacttctgagttcaacttttttagattctgcatataagtgagattatgtggtatttatttttctgtctctggatcatttttcttaatataatatcctccaggttcatccacgttgtcacaagcgacaggatatccttctttttttaaggctgatagcattccattgtatatatatacaccacattttctttatcaacttatccattaatggaacataggttgattctatttcttggctgttataagtaatgaacatgggagcccagatatttcttcaacatactgatttcattttccttggatatatacttagtagtggaataatataatggatcaggtggtagttctatttttaatcttttgaggaagcttcatatcatttttcatagagggtatactaatttacactcccaccaatagtgtgcaagggttcccttttgtccacattctcaccaacacttgttatctcttctttttttgaaaatagccatcctaacatctttgtgcactctatgccttctgtgagctgatagctcattgtggtttaaatttacacttccctgatgattaaagatgtcaagcatttttcatatacctgttggccatttctatatcttctttttaaaaaactatattcaggtcttttgcctgttttttaattgggttatttattttcttgctattgaattggtttagttccttatatatttcagatattaaacgcttatcagatgtattcaaatattgtctcccattccataaaatgtctcttcactctgttgattgtttccttggcagtgcagaagccttttagtttcatgtaatcccatttatctatttccacttttgttgccttgcccaatggagtcatatccaaaaaatcattgcccaaaccaatgtcatggagcttttactctatattttcttccaacagttgtacagtttcaggttttacatttaagtctttaatcaattttgagtttatttttgtatatgatataaaataagggtatgatttcattcttctgcatgtggatgtccaattttcccaacaacatttaaagacagaatccttcccttactgtatattctgagcacctttgtgataaatcaatttactatgaatgtgtggatttatttctgactactttattcttttacattggtttatgtaatgttaatgccagtaccatgctgttttgattactatagctttgtattatgttttgaggttggtagagtgatgatttcaacctttttctttttgttcaagattgctttggctattcatagtctattgtggttgcagacaaattttagaattgctttttctatttctgtgaaaaatgacataggaattttgataaggattgcattgagtctgtagatcgctttaggtagtaggaacatttgaacaatattagttcttctaatccatgaacatgggctatctgttcatttatttgtgttgtcttcatgttttacagtttacagtgtacagatctttcacctccttgtttaaatttatttctgggtattttattttatttttatttttatagctgttgtgaatgggatttttttatttctttctcagattgttccttattagtgtatagaaatactactgatttttatatgttgactttgtatcctgcagctttactgaatttgtttatctgttctagcaattttttgttgaagtctttagggttttctatatataaaatcatgtcatctgtaagcaaggacaatttaattttttcctttccaattttggatgccttttatttctctctcttgcttaattgctctgaataggattttgaattgagtagagtagagtagaatagaggagttacactgaatagaagtggcaagagtaggcatctttgtcttgttccttgtcttagaagaaaagctttccacatttcactgtttattctgatgtgagtttgttatacatggcctttattgtgttgaaatacattccttctatatctaattgttaagggtttttatcatgaaaggatattgaattttgacaagtgcttcttctgtatctactgagatggttccatggttttgttcttggttctagtaatgtgatgtattatgtttatgtatttgtgtgtgatgaatcatccttgcatccctgggataaatcctacttgatcatggagaatggtccttttaatgtgcttttgagttagtttcctggcattttgtttaagatttttacatctgtatttatcagagatattagcccataattttcttttcttgtagtgtcctttcatggttttggtattagggtaatgctagcatcaagaaatagtttgaaagtatccccttttcttccattttttggaaaagtttaagaaagattggtgttccagtgaagcttccagtgaagctgtcaggtcctgggcttgtctttgatgacagacattttactactgattcaatctctttacttattattggtttatttagattttctatttcttcaagaaaattttagtcggttgttgtgtgtaggaattgattcatttctcatgcatataatttttcagaatggtctcttatgaacatttgtatttctatggtattggttgtaatgtctcctccttcatttctgattttgtttttagtttgagccttctctttttttttttatgatttagtctagctaaggattggttgattttatcttttcagaaaaacttgtttcgttaatcttttctactgttttaatgtgctaactcaaaagcacattaaaaagatcattctccatgatcaagtaggatttatcccagggatgcaaggatggctcattacacacaaatacataaacgtaataatcacattactagaaccaagaacaaaaccatggaaccatctcaatattttctactctctgtttcatttatttctgttctgatctttattatttccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgactgctgtgatgtagtatctcattactgttttttgatatgcctctctctaattattagtaatgttgaccttttttttcatacacttgttggcccatgtttgtgttcttttgaaaagtgtttgtttatggcttttgtccactttttaatgagacttttttttttggcttgttgatttatttaagttctttatagattctggatattagacctttgtcagatgtatagtttgcaaatattttcagccattctatagattgttttttcaattgtttcttttgctgtgcagaagctctttagtttaattagatcccatttgtcaatttttgtttttgttgcaattgtttttggcatctttgtcatgaagtctttgctatggcctatgtctggaatggtatttcctaggttttcttctagggtttttatagtttggggttttgtatttaaacctttaatccatcttgagctgatttttgtgcgtgttgaaaggaaggggtccagtttcaatcttctgcatataactagccagttacccagcaccatttattaaacagtgttttcctaatttcttgtttttgtcaactttgtcaaatattagttggttgtaggtatgacactttattttggggttctctattctgttccattgatctatgtgtcttcttttttaaccagtaccatactgttttggttcctgtagccttatagtataatttgaagtcaggtaatgtgatgcctctgggtttattctttttagttaggattgctttgactgtttgagctgttttttgcttccatatgaattttacaattgttttttctaattctgtgaaaaattgcattgataatttgataggtatcacattgaatgtgtagattggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaatgtcacacttacatctttttatatggcatatttcttaacaaattattatacctagtgttatttttaataattttatcttttaacatttattctaaaataaaagtgatttacatactaccatgaaaatattagactactctaaattggactgtgtgcttacttttaccagtgagttttatactttcatatgtttttatgttataattagcctccttttctttcagctaaagaaccccctttagcagttcttgtaagataagtctgttggtgaggaatggttaatttaaatataacaaagtacaaaaagttcattggtagagtttcaggtttcatatttccactaacctttaagaaactatcatttgagtttagtctgttattaaacagaaatgttcacaattatgtgaaaagtttattaaaatattcctccttttcctcattatttatctgtgtgaggccaggttttattcatttacatcaaccaaaatagcacattctaatagatttaattcagaagcagttataaaaatacagtcatcttcaagtctgacattaaataaatttgcaaaaatgtaaaacaatgtcactcttctcactctattttttattgtttgggaaagcacaataatttttatgaaaatattattttaacaaaatcaatttattattttcattttaaaaattaggatttaaaaatttttccatttcaatttctaatacggtaactagtgataggtataacccaactcaaccaaaatctttaggattctcaaatgtttaagagtgtaaaggagtcctgaaacaaaaaagttaaacaacctagaaaaaaacaaagatattaatcagtatgatagcattcatcgattcaattaccatcatggcatccctaaaagcccatggtatatagttacatctcactgagccaccactttgaaactcccaccctgcaccaggtacttgtgagcgtgtaactttgttaatcaactgttcagggctgtatcccaacatggctttgctgcactttttgtggcacctctggtaaatctcattaggtagaccaaagggatcagttaactttttctttataacttttatttacgatattttataagtttggtaatttgcaaaggtcttggacaaagaccaggggcttatcaataataatttatctcttgaagaaacaaacaatataattggttatggagcacaggcatcataagcagaaaacaggtttataagtaaagggggaaaacctagtgtgtgttgcttgcatcaggaattcatgttaccatttggcaatatgaatttgcttagcagtgtgcagtgtgctttttttttttttttttttttttttttttttttttttgacaggattttgctctgtccccaggttagagtacagtggcccaatctcggctcactgcaacctccacctccagagttcaagtgattctcatgcctcagactcctgagtagctgggattccaggcacaagccaccatacccagctaatacaactaatttttgtacttttagtagacacagggtttcaccatgttggccagactggtctcgaactcctgacctcaggtgattcaccaacctcagcctaccaaagtgctgggattataggcatgagccactgcatccagccaccctttttagtaaatacattttgcatgaccgtgtagttgtttacagctatttatctagtaaaccaataacttacagttttttaaagacttaatggatagcatggaattattcatgatatctgcgccatatcttgagcacccactgtatacctgatgttgtactgggctttggaaatgaaaaataatgagttatcttggggaatttacaatgtaacatagaaagcttgtataactaaatttgcacaatgaaatataattaatgatagaagaagtatattatctggcagagcagagtggggaaaagtaccagcaaagacttagaatatcagctgtcctcaatacttgcacttagacttggatgagaaacagttccctgcacaagcggatgacagggttaggtatgataggagccatgtaagtaggagccactcaaaatctgagtttggtgtggctggtgtggagggttgagagaatatgaagagaggaccacaacttgaattactgagggcccttttttgattctattagtgaaatctttaaagaaattgtattggtgacagtaacagagaaataagggctttgaggatgaaaacataggctaaaaaaaaaaaaaaaaaaagcctaagaaaaaataataaagttcagtattcagtgtcctgccttaaaagcattttaggcatgcaaatatcccatatattcagaagatcctataaaaaatataaacaaaccctgtcatatacacatgaggcagaaaaaagatactttgtgagtagaaactaattgaggtaaaagaagaagaagaacttgttttagaagctgaaggcccagctgctgacttaataaaacaaattatgagaattttatttatgtgaaaatccatcctgttgaaaaaccgagtgtttaaagttttctataaacagcaacaaggtgttctaccaaaaatatatatatatatgaaaagcacattgaatacctgctttgagtatttgacttggaggaaaatagcatcactagttgagtatctctttgatagcaatatgtgttaaaagtctaacaatctcactctacccttccctgagaacgtaaaggaatatcctaaccttaagggttgtgagacctagatatttcttaccaaagaactcctgtgactctttattgcaaattttaaatagcaaactgttttgtggtggcttttagccttccagaacaagcgtattagatatgtagttccttttaataaaagtatttggaagttcaataaaggcaattatgatttttctaggaccttttccaattctgttattatgtgaatgactacccagaatttccatcaaacactgatatacaacttgctatggctacaatttattttggtgtggaaatatgtttgtttttctgttcttatgtctcccttcatacaaaagtgtaatatcccggatatgtagacatatagttctgccattcagagtaattctaatatgctttaatcttattaactatctggaagactaatgcacagctgtagctgcatttctttaagtgagtctatcatatatttgggtttataccaaactaaatttgtgaactattatccatttaaaaaatgattatttacataattatttgccttaatcttcctttaaatagcaaatgctcacgatgcattttaaaatattacctactttataaaaatccattctggatgcaaatgggggaatacctgtagtgtttattgcattgagttgttgattctttagccaatatgcatttatattttgtcttgaaagatggatcctatattgtcaacatcagttccagtgtactcattgaaagtggataaggaatatgaagtgcgtgtgagatccaaacgacgaaactctagaaattatggcgagttcagtgaggtgctctatgtaacacttcctcagatgaaccaatttacatgtgaagaaggtaaaagaaataaaagattaaaatagcagctaacctggcttttgtcaatataacagttgattcaaccctgcactgttagtgtgttgtccagatcaaaatatattagcatcagatatcacggtgagagaccttgagctcaacatctgaaacagatattgttcattgcaaaagcagaaggaagatttagtttccaaatttttcattcaggaaatgtccgggggacaggtggaagtttagagacaggaattcggtggcaatctccagatggtacaattcagatgattcttttctttatatatgtttatgttcccaaaattttctgtagtaagtttgttttgaatttataatcaggaaaaaaaaaagctgttctgatgattagggaagaaagtatgtttctatatggatggagagatatgtggcatctaagaggaaacctaatattgagtcggcataggtagtcaacagcagctgcataggttttagaaagtggaggtatggctttttcctagaggaaaggctaataagtagggtggcagtcatactcaaaggagacatggaacatttgaaaaccgtatgtaggagaatcacaacaatgattaaagttttttaaaatgggacctatgaatttagaataaaagaattaaaacttttagatacagaaataaagaaaactgattaataatgagcagaaagtatagagtattatgattctcaaatgggaattggctctattctatcttcactgaaaacagacgtttacagggctatatgtttgttaatgagataaccacaagctacatagaaaataaatttatatttctgcatttactatacaggtagaatctcatgatactaaatagcactagaatgaaaatttctgtagcaccattttctctaaactctagttaactgacttcttgtttccaaactatttgatataatgcaattctggtcttaaaagtatgatagctgtacacccttaagcttagtgtagtggcatttaattcacttaacatatattttttaaaatgtcttttcctctgttactaacaaaaaaagaaactctaactttatgttattttcctgaatatgtcactgatatgaaattagagatactacaagacaaaaaatgatttttttctcccccaccaattctttaaaatgcttatattatctccctaggggattttaataacttattaaataagaaaagactatttcagcataaaggcctacattttcaatggcaatgttcagataaatttcatctgtcatttctatgaaaaagtggttagcctctgtctctgtggtaagaatactgggaaccaactgcaaagtagctggcaggtacttaatcttaaggaatgaaatagaagttttacaaacaggttcccccaagtctcatacaaagtatactaaaacctgaagatgggagctcaatagtgatctttctgtcaattttatgtatataatatacatgatatatatttattatattttaataatttaatttcttgatataaatatgtatatttatagctgtaaaatatatgttctttgtgtctaagaagtttctgtcatgatttatcaataaaaactctgccttcatctttttgataaatcttcaatctagaggctatgataatcaccacacttaaaaaaaagtagaaaagaaaccaagtgggcattatttaggtagtgtgttaataagcaacactttttgcctagagctgaaacctttatgatactcccttgacacataatatgcttaaagcagattgtttgttttcataaaacacactgattttgcactatatgctgtttctttattttgaagtttttttaatgaggagatttgaaaagtggacagagatgttcataaaacagaaaaaaaactaagtcattgcattctgtttcagtggttatcaagagaaatcagtggctttattagatgaatacaaactgaattttttgtgaaaagggaaagggaaatgtaaactgtgcttcaactatttgtaattctgagagcgaaatattattgtgtgtttcagatttctactttccatggctcttaattattatctttggaatatttgggctaacagtgatgctatttgtattcttattttctaaacagcaaaggtaggtgtgaagtagtattctttggtattttttgccagttgtttagatttccatgtgtgtttctatttgttatttgatattttctttgtcaaattatgagtggaaattttagttaacctagtaaacttttatctccagttatatatttaccatttatataaaacccaatttgttgtatttatcatagacaacttagaggtttagattctatctggagacttgtacaggacattaagaggcttaggctggtgactatgcatacctcgtgatgtgtacctctttatccaagagctagctcttcccctcgagtcctcaacaagtttacccattcattccagatcttcagagtatcactgagcctttggctgagtctgatacagtccttatatatagacatttttttttccttgagatggagtctcactctgttgcccaggctggagtgtaatggcgcaatcttggctcactgcagccgctgccccccaggttcaagtgattctcctgcctcagcctcccgagtagctgggattacaggcacccaccactatgcccggctaatttttgtgtgtttttggtagagacagggttttgccatgttggccaggctagtctcgaactcctgatctcaatacacaggcaaaattttaagtggcaaactacccaggtagatagttaagtctaataaaacattttttagacttcatatgatgatgatttcaagtaaattcaggtttaatttaaattatttggatatttatgattttgtgtttcacctgcatttataaacacagctaaaagtctttataagtgtaaagagatttcattccactttctcttggaatcaaaagccttgagttccagttatcatttttgtcattgctgtttgaccttgtttgagtcccagaatctctccaggcctccatattcttatggttaatatgagggtatgggttatataatctttaaattttccttgagctatgatatatgttatttatattattccatttttcttcctgatagaaactcactacacactacaggaaatttttttaaacaaaatatgggaaaaatgattggtactgattgccagtgtcctacatttaaggttgttttgtttgtttgtttgttgtttttttctttgttttgttttgctttgttttgtttttttgagatgaagtcttgctctgtcacccaggctggagtctggagagtgcagtagcccaatctcagctcactgcaacctccacctcccaggtcaagcgattctcctgcctcagcctcccgagtagctgggattacagggatgtgccaccacgcccacctaattttgtatttttagatagtttcgccatgttggtcagactggcctcgaactcctgacctcaggttatccgcccgcctcagccttccaaagtgctgggattacaggcgtgagctaccgcgcctggccccatttaaggtatttttaaagtcccaatggttaaccttgcttcttctcctagaactaaggtgactgacactcccaggttgcctagagctctcctggtttttagcaatgcaagtcctgtgtgccaggaaatccctcagttccaggtaaccaaggcagttggtctccttacctagaattgaaaataggttctccagctgaagccaaaaggcatctataaatcaaaatgagatctatgttaatatattttaaagtattttaatttgttttgtaacgtagtataacatttgtaaacttcaaaatagaattttcttaggaagaagaattattgggacactagagttctcgagtgtcaagcatgctaaaagtctaactgaatgcagaaagggttattttcagtagagttttatgtccaattttataatataaaccaatgggaaagtaaaattcattctgcagaattccattttgcacctaactttctggcaacatttctattttccaaaaaagcagctatcataaatcacaatacaattttctgttgtttcaggaaaataaataaatatatttttagatttttaatttgtgtatttaagtaatgccaacaaaaaaagaaccaaattattctgttgattaatttcagttttttaatctatctatcttgtggggaaatttatacataacttcaatagataaactcacgaagtatataaagtaattatctcttagtattagttgtgaatttctagccattgtgaaggccaagtcaatttgttatgttgtttagttatattagctaacaatattaggaagaaacaattatcctctcaaaaagtagaatttccaagaaaacatattacttctaatagagtgctttttataaataatgaaattcttaactataatgtttagtcagaatcaccagattctacaattaatttgaaatctttattgttctcccaattttcctgcactaaattgaattttctgtaggaaagaattaacttttttttcatttgcccaataaaaacccttatcgttgtctaaatttgcatgttctactgaaagtgggaaatagtagcaaatatttgtcagcaagtatggacagaacatgtagttccaacaattaaattgatactacaaagaatgagatttttcttagaactgtagggctgtaaagtggcttcaggtcctacacgcctttgaaattttgtgagtccacaattcattatccaacccacttcaccctgctttaatccagttacttgagtcaactctagcaaaatttataattttatttgtatctgatacaaaatcacaaacttagtttcaagtcaggctatactggttcctaccacacaacccacccagcctttgagctgttaccaattgaggaaagaaataactgaatcagcccaaaatagaacttccaaaccaatagccaaattcagcctacagattcacattttattttattttaattagttttgattttagagtgaagattttcctacaaagtgtttgtaaaatacagaattttcacacaaaaatccagatttggggattatcttttaaaaaatgaaagatgtagtgaaactgaataaggcggcatatgctgcagcagacaaccagctgtcctatttgggactggcacacattctttaatgtgccaccatcctcattcctcctaatgactttgcaactggcttgctttattcatctgcatgatctgcttgggccccttagatttatggtctgccactgtgacataaggtcactacaacccctagaaaaccactagcacatgcctgaatgcatcatcctattcaaaaaggagaagcacacgtcacaaagtcaaacatcagccatttggaaacctttgcttcctgtcattagagttatgttccatctttttatgttttggagaatgtgaaatatcgatttagagatgcagaatcaagaaaaaaaaaaaaaaacagcaaaacagcagcatgacgcaaagaacctgggttttggtttggagtcaggttctctgggtttgagccccaactgtgccaactatcagtgcatgatttgaacatgttccttaattttccaagtttttgcacatatatatcatctgcctccctgggagtcataaggattaagtgaaatgtttagtgcaggggtcacaaacttatttcatggagtcagagtacatttttatgcttttcaagccatacagtatctgtcacaactactcaactctgccactgtggcatgaaagtggccatagacaatatggaaatgaatgaagatgcttgtgttctcataaaattttatctacacaaacaggtgacaggccagatttggcccatagaccttaatttagtgacccacagtttagtgcaaaatatatcccacagcgtctgatttatcagaagcactaaaaaatgagagtagttattattaataatttgtattgcttatttctatatctgtaattcattagtaagaatttgctttaacatttgccccactgagtagtagaggctacttaatgcaatttataaaatggaatttcccttattgcttggattaggtaaaatggcaagtagaaatattgagagaatgtattccttatgtaatggactagactgaccattcacactgagtggaatagcaactgatatccaaaaatcaggttaccacctcttcatgacagtgtcatctctgaatagtcaggagtttttttaaaagttaaatgaattgtttggaataatatctgagccttttttcagtgctataatttgatttttaaaaataaactcaggccgggcgcggtggctcacgcctgtaatccctgcactttgggaggccgaggcgggcggatcacgaggtcagtagattgagaccatcctggctaacacggtgaaaccccgtctctactaaaatacaaaaaattagccgggcgcggtggcgggcgcctgtagtcccagctactccggaggctgaggcaggagaatggcgcgaacccgggaggcggagcttgcagtgagccgagatggtgccactgcactccagcctgggcgacagagtgaagactccgcctcaaaaaaaaataaaataaaataaaaaataaaataaaataaaataaataaaaataaaaataaactccaggccagatacaatggcttatagcatataaatccagcactttgggaggatggggcgggaggattgccctgaggccaggagttccagacggctcgggcagtgactagagcaagactccattacaaaaaatgaaacaataaaaattagcctaccctgtagtcttagctacttacgaggctgaggcaggaatatcgcttggcccaggagtttgaggctgcagtgaattatgattacactactggactccaacctgggtgataaattaagatcctgtctcaaaaagtttaaaaaaaaattaaaaacaccataaactccaattacactattaattgtacaaaatagatacatgattaattcatttttatgaccgaaaaataatttaaagatttgcaacagaaaatgtaaatgcatccttgaattgtgtatataaacccatactgattagttagagatagttcaaatttagtctgtcccatctgaaatgaatcctctagtaaaaccctgtttaataagatcatcttagataatttcataattaatatgaactatatagctaacctacccaagtctaccctttttcaagggtgcaggtaatcttggctccatgtgtattgacccttttctcgttctttcttttctgtacaaattactgatgagatgtacactggaattgccttatagctgacatggaaatcagcttcagatgaaattaaatgtcttactttcaaatactatatctggctgaaaataaaaaagcattaagaaaaaaaggattgtgggaaaaacacattttcttttaatagacgtcagatgaggtttttcgggttttttaattgttcttttttttccttctacaatttttctttctcatttgctgtctaatattttcttctgtttctcatactccaattatataaagtaccagaatatttgggaaagtaatagtattgccaatattttatttctatcttttgctattattgagaatatgtagcttttaagatgtcaaaaccaaaattttatatgttttcaaggattaaaatgctgattctgcccccagttccagttccaaagattaaaggaatcaatccagatctcctcaaggtaattaataattttatctaaattgtggccagtactaattaacacctgaagaatcctgtcatatgtttaaagttttctgtgagctatatatatcacattcaattttcttgtatcttgtctcctagagaaaattttttaaaatattctctcttaaaaataagaaaatgtcatatgtataaaaagttatgcactaatttatgttttgtgatatgttttgttactgttgttcttattgtaaccataattaatctctgaacatcatttgctaattcatttaattattatgagtttcttttcatagatcttcattttctttctattttctaggaaggaaaattagaggaggtgaacgcaatcttagccattcatgatagctataaacccgaattccacagtgatgactcttgggttgaatttattgagctagatattgatgagccagatgaaaagaatgagggatcagacacagacagacttctaagcagtgaccatcagaaatcacatagtaacctaggggtgaaggatggcgactctggacgtaccagctgttatgaacctgacattctggagactgatttcaatgcaaataacatacatgagggtacctcagaggttgctcagccacagaggttaaaaggggaagcagatctcttatgccttgaccagaagaatcaaaataagtcaccttatcatgatgcttgccctgctactcagcagcccagtgttatccaagcagagaaaaacaaaccacaaccacttcctactgatggagctgagtcaactcatcaagctgcccatattcagctaagcaatccaagttcactggcaaacatcgacttttatgcccaggtgagcgacattacaccagcaggtagtgtggtcctttccccaggccaaaagaataaggcagggatgtcccagtgtgacatgcacctggaaatggtctcactctgccaagaagacttcattatggacaatgcctacttctgtgaggcagatgccaaaaagtgcatccctgtggctcctcacatcaaggttgaatcacacatagagccaagctttaaccaagaggacatttacatcaccaccgaaagccttaccactactgctgggaggcctgggacaacagaacatattccaggttctgagatgcctgtcccagactatacctccattcatatagtacagtccccacagggcctcatactcaatgcaactgccttgcccttgcctggcaaagagtttctctcgtcgtgtggctatgtgagcacagaccaactgaacaaaatcatgccttagcctttctttgatttcccaagagctacgtatttaatggcaaagaattggctggggcaataatgtttaaaccaaaacaatgtttaaaccttttttgcaggggtgacagggtgggatatggattctaaaatgccttttcccgaaatgctgaaatatgatgttaaaaaaataagaagaatgctcaatcagatagatatttctattgtgcaatgtaaatattttaaagaatggtgtcagactgtttagtagcagtgattgtcttattattgtgggtgttaatttttgatactaagcattgaatggctatgtttttaatgtgtagtaaatcacgctttttgaaaaagcgaaaaaatcaggtggcttttgcggttcaggaaaattgaatgcaaaccatagcacaggctatttttttgttgtttcttaaataaaaaaacttttttatttaaaaaattaaattaaaactagaggtgagaaaatcaaactgtaagcaagaaggcaaaaatagtttggatatgtaaaacatttattttgacataaaattgataaagatatttttaataatttagacttcaagcatggctattttatattacactacacactgtgtactgcagttggtgtgacccctctaaggagtatagcaactacagtctaaagctggtttaatgttttggctaatgcacctaaagaaaaacaaactagttttttacaaagcccttttatacctccccagactccttcaacaattctaaaatgattgtagtaatctgcattattggaacataattgttttttaaacaaatatttttttagcaaatttttaaacaaatatttgttaatttagaaaactttaaagtgtttgcacagatcaacttaccgggcaccaaaagaagtaaaagcaaaaaaagaaaacctttcttcaccaaatcttggttcatgccaaaaaaatacatgctaagagaagtagaaatcgtagctggttcatactgaccaagatgcttaagtgctgcagttgcacatggagtgagttttttagtgtgtgcagatggtgagagataagatctatagcctctgcagcagaatctgttcacactcaacttggttttgttacataattatccaggaagggaataaggtacaagaagcattttgtaagttgaagcaaatcaaatgaaattaactgggtaatcaagcaaagagttcaagaaataggtttttgtttcacagcctataaccagacacatactcatttttcatggtaatgaacagaacatagaagaaacaaggttttcagtccccacagataactgaaaattatttaaacctctaaaagaaactttctttctcactaaatcttttataggatttatttaaaatagcaaaagaagaagtttcatcattttttacttcctctctgagtggattggcctcaaagcaagcattcagaagaaaaagaagggacctcaataatttagaaattattttgcaatcccttaatatcctaaacatcaggttttgttgttgttgttgttgttgttgagatggagtctcactctgtcgccaggctagagtacagtggcgcgatcttggctcactgcaatctccacctcccccaggttcaagcaattcccctgcctcagcctcctgagtagctgggactacaggcacgcaccaccatgccaggctaatttttttgtatgttagcagagatggggtttcaccatgttggccaggatggtctcaatctcctgacctcatgatccgcacaacttggcctccaaaagtgctgggattacaagcgtgagccaccgcgcccggccctaaacatcatttttaagagcattgggatatttcctgaaaaggtttatgaaaaagaagaatctcatctcagtgaagaatacttctcatttttaaaaaaagcttaaaactttgaagttagctttaacttaaatagtatttcccatttatcgcagaccttttttaggaagcaagcttaatgcctgataattttgaattccctttcttgcaggaagggctatgaaaagctagaattgagtgtttaaagttcaacatgttatttgtaatagatgtttaatagatgttctgctactttgctgctatggttttctccaagagctacataatttagtttcatataaagtatcatcagtgtagaacctaattcagttcaaagctgtgtgtttggaagactatcttactatttcacaacagcctgacaacatttctatagccaaaaatagctaaatacctcaatcagtctcagaatgtcattttggtactttggtggccacacaagccattattcactagtatgactagttgtgtctggcagtttatatttaactctctttatttctgtggattttttccttcaaagtttaataaatttattttcttggattcctgatagtgtgcttctgttatcaaacaccaacataaaaatcatctaaaccactctgtatactgtgaattatcattgtaaggagagcttagcaccactggatcaaatacatcagccctgggtatggagatttttatgggctgggatatagagagggaaacataaaccccttcccttattttttgaggagacaaaagcccagctcagaaatatcctactggcttggccctccccttaggctgtgactccccatgggcaaaggttcatagagctgtgtatttgatgcatcatagaaaataaatgacatgggtgtggagtgagggagagtgacatgtgagcattatctttatatttccagcttgagcatgttgtctggaaggaaggaaagcagctcttcctctgccattcacccattggcctaactcagtttattggactagctgcttgttatcatgggaatcagctaataagtcaggcttgggagaaaagctgattaggtaggttgtgtaggagcttgagagagccatgaagtatagattcctacaacaggaggcaggctgcaggtgaggtggctactgaaccctaggctcctgagcaggcactggattctgaaatgtaggaatctggtgatgacattgataaatctactaaacaatgaggtattacttcagcaagtcgaatgcaaaatgccacaactttctataatactcaagggttatatttaaaaaaaaaaaaaaaagtcttcatctgctgccttctgccctgtgagcagtcattacctgaaagaactatggagtgaagcctcagggattcttcatatggatgctttaaggtatgaggagtatagggaaaaggaagcctgcctacttccatggattgaaataacacagttctgtttcagaagattaatgatgtgttgaaaatggctacacacgtttcagcatttcagtttctcaaagtttctaacactttattcaagtgctataatatttacatatttacatatttttataccaaaatatgtctttttatgtgcttgttatgtgggtaagaaatagtgaccagaaaaaccagaagttacttaaatataaactttttagtttggaatccaaaatcccacataatttgccccagtctcctttgacagtttagaatttaagacctagatgtaaatatgtctggaataggtggcttcttggtctcactgacttcaagaatgaagctgcagacccttgtggtgttacagttcttaaagatggtgtgtccggagtttgt

SEQ ID NO: 2333 - DNA, 4178 bp, Mus musculus
gacaacccacgagctgccaagcagggcgcagccatgggaagaggaggcggtctagggagcggcggcactggcagaggcggctgctacagcggcggtggcggcgacggctgttactgaaccccggcagccgcggggatcccgggctgggtccacgcgggcctgaggcctcggctccagcagcccccaagcggacacgaacccgcgttctgtctcccgaggcgaaactccgaggtctcaggtatggatctttgtcaggtcttcttaaccttggcactggcagtcaccagcagcacattttctggaagtgaggctacaccagctactcttggcaaagcttccccagttctgcaaagaatcaatccaagcctggggacaagttcttctggaaagcctcgattcaccaagtgtcgttcccctgaactggagacattttcatgctactggacagaaggagataatcctgatttaaagaccccaggatctattcagctgtactatgctaaaagggaaagccaacgacaagctgcaagaattgctcatgaatggacccaggaatggaaagaatgccctgattatgtctctgctggaaaaaacagctgttacttcaactcatcatatacctccatttggataccctactgcatcaagctaactacaaatggtgatttgctggaccaaaaatgtttcactgttgacgaaatagtgcaacctgatccacccattggcctcaactggactttactaaacattagtttgaccgggattcgtggagacatccaagtgagttggcaaccaccacccaatgcagatgttctgaagggatggataattctggagtatgaaattcagtacaaagaagtaaatgaatcaaaatggaaagtgatgggccctatatggttaacatactgtccagtgtactcattgagaatggataaagaacatgaagtgcgggtgagatccagacaacggagctttgaaaagtacagcgagttcagcgaagtcctccgtgtaatatttcctcagacgaacatattggaagcatgtgaagaagatatccagtttccatggttcttaattattatctttggaatatttggagtagcagtgatgctatttgtagttatattttcaaagcagcaaaggattaagatgctgattttacccccagtcccagttccaaagattaaagggattgatccagatcttctcaaggaagggaagttggaggaggtgaacaccatcttaggcattcatgataactacaaacccgacttctacaatgatgattcctgggtcgagttcattgagctagatattgatgaagcagatgtggatgagaagactgaagggtctgacacagacagacttctaagcaatgatcatgagaaatcagctggtatccttggagcaaaggatgatgattctgggcgtaccagctgttacgaccctgacattttggatactgatttccataccagtgacatgtgtgatggtaccttgaagtttgctcagtcacagaagttaaatatggaagctgatctcttgtgccttgatcagaagaatctgaagaacttgccttatgatgcttcccttggctctctgcatccctccattacccagacagtagaagaaaacaagccacagccacttttgagcagcgaaactgaggcaacccaccaactcgcctctacaccgatgagtaatcccacatcactggcaaacattgacttttatgcccaagtaagcgacattacaccagcaggtggtgtagtcctttccccaggccaaaagattaaggcagggatagcccaaggcaatacccagcgggaggtggccacgccctgccaagaaaattacagcatgaacagtgcctacttttgtgagtcagatgccaaaaaatgcatcgctgtggcccctcgcatggaagccacgtcttgtataaaaccaagctttaaccaagaggacatttacatcaccacagaaagccttaccactactgcccagatgtctgagacagcagatattgctccagatgctgagatgtctgtcccagactacaccacggttcacaccgtgcagtctccaaggggccttatactcaacgcaactgctttgcctttgcctgacaaaaagaattttccctcctcgtgtggttatgtgagcacagaccaactgaacaaaatcatgcagtagcctttcctatctttaatggcaagggaaaggctgggcacaaacgcttaaaccaaaactatgttttaaatctgtgttgggagagcatgagagtggatatggattctaaaatactttttctggaaatgtcaaaatatcataaagtggaaaatcaagaattcgtaatcagataaatgctcccattgtgaattataaatattttaatgaattgtctttaagactgtatagtggcagtgattgtctgtactgtgggtcttaattttgtgatactaagcattaaatagctacgttttttatgtatgtagatcatgctttttgaaaaagcaaaacaatcaggtggcttttgcagttcaggaaattgaatgcagattatagcacaggctgattttttttttcttttttaaataactgggaactaaaactctaggtgagaaggtaaaactagtttggatatgcaaaacatttattttgacatgaaattgataaagatatttttaataatttacactttaagcatgagtactttataatatgctacacacatattgtagttcagaacaatccatctaaggatgtagcagctacagtgtaaagagggtttcatgttttggtcaatgaacgtaaagaaaaccaaacaagttagatttttacaaagcccttttataacttccaaaacttcttaactctaaaaatgtctaataacctgcattattagaaaaaaacattttaaatttgtaaacgaatatttttttaattttgaaaactttatttttttttaatgttgaatcaacgtatcatacaccaaacagtaaacagaaattataataatggaagaagtgctttcttcgacaaatttccattcaagccacacagctacatgtaagagaagtagaagtgatgtggtgtgattggctaggatgcagaagagcttcaggaatacaagaagtgagagcccaaggattgggaggagggggctctcacatctccacagtgcagtctgtcaaacccagcttggtttttatagtattctaagaattattgtgtacaaggaaaagtctcacatgtatgaaatccagtatccagatggggtaaagttagcagataataggataggaaattaaagacctagatcttttttcacagacagacacaaatttttaattcagggagaagggacagaataaatgacttcccactcacaaagcacaactcagaagtaattaaacaggtaacagaaaccttgccatcaaacctttgataagatgtattttaagtagtaagcagtatttcaatgcttcttacttaccctcccaggacaaccgatctcaaataagggagataaggtagataaaaatcactttttgattctgtaataacataaacatagttctttgggttagcaccccccccaaaaaaaatttatgggagaaagaggactctcagctgactgaagaatacatctcatttaaatattttttagatgcctgaaactttaaaattacctttaagttttaatggtatttaccattttgccaagacctttgtggggaaacaagcttaatgtttagtgattttgaaatctctttcatgcaggagagacagtgaaaatctagccttgggtgtttaaggttcgccttgttactttgtaatagattttaataagtttttctgctactttgctgctatggtttctccaatggctacatgatttagttcatatgaagtatcatcaacttagaatctattcagcttaaagatgtgtgttttgatgaactatcttaccatttcaccataggctgaccacgtttctatagccaaaaatagctaaatacctcaatcagttccagaatgtcattttttggtactttgctggccacacaagccgttattcaccgtttaactagttgtgttctgcagtctatatttaactttctttatgtctgtggatttttcccttcaaagttcaataaatttattttcttggaaaa

SEQ ID NO: 2334 - DNA, 20 bp, Artificial sequence
  Synthetic oligonucleotide
tgccaactcacttggatgtc

SEQ ID NO: 2335 - DNA, 20 bp, Artificial sequence
  Synthetic oligonucleotide
gagacttttccttgtacaca

SEQ ID NO: 2336 - DNA, 20 bp, Artificial Sequence
  Synthetic oligonucleotide
tcagggcattctttccattc

What is claimed:

1. A compound comprising a modified oligonucleotide and a conjugate group, wherein the modified oligonucleotide is 15 to 30 linked nucleosides in length and wherein the modified oligonucleotide has a nucleobase sequence comprising a portion of at least 15 contiguous nucleobases 100% complementary to an equal length portion of nucleobases 153921-153940 of SEQ ID NO: 2.

2. The compound of claim 1, wherein the modified oligonucleotide comprises at least one modification selected from at least one modified internucleoside linkage, at least one modified sugar, and at least one modified nucleobase.

3. The compound of claim 2, wherein the modified internucleoside linkage is a phosphorothioate internucleoside linkage.

4. The compound of claim 2, wherein the modified oligonucleotide comprises at least 1 phosphodiester internucleoside linkage.

5. The compound of claim 2, wherein the modified sugar is a bicyclic sugar.

6. The compound of claim 5, wherein the bicyclic sugar is selected from the group consisting of: 4'-(CH$_2$)—O-2' (LNA); 4'-(CH$_2$)$_2$—O-2' (ENA); and 4'-CH(CH$_3$)—O-2' (cEt).

7. The compound of claim 2, wherein the modified sugar is 2'-O-methoxyethyl.

8. The compound of claim 2, wherein the modified nucleobase is a 5-methylcytosine.

9. The compound of claim 1, wherein the conjugate group comprises:

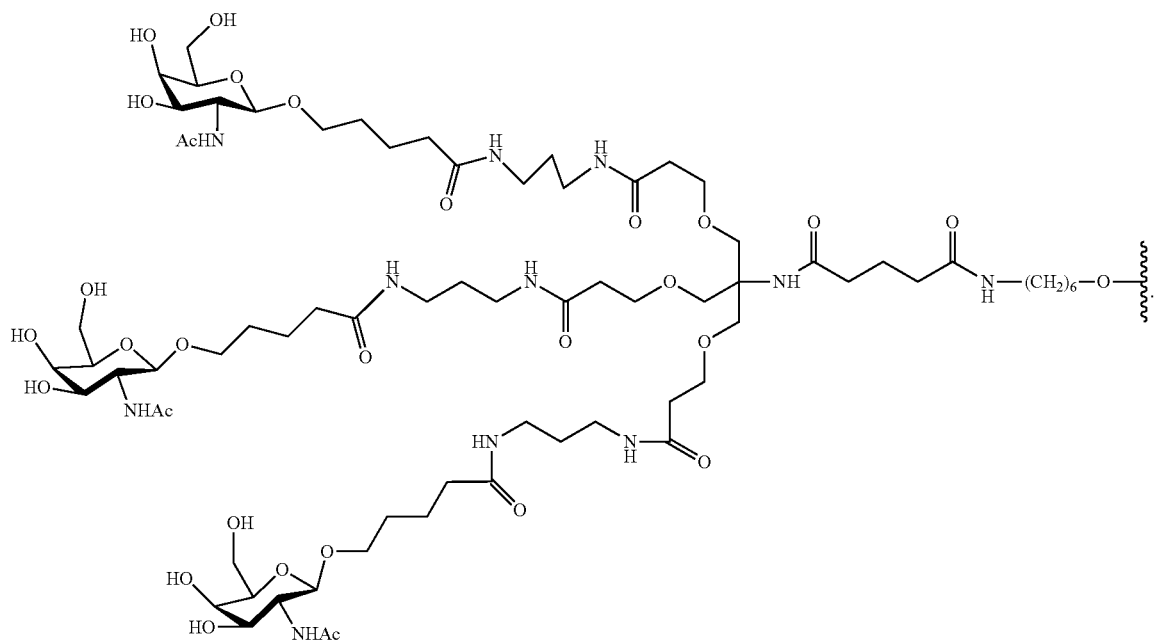

10. The compound of claim 1, wherein the conjugate group comprises:

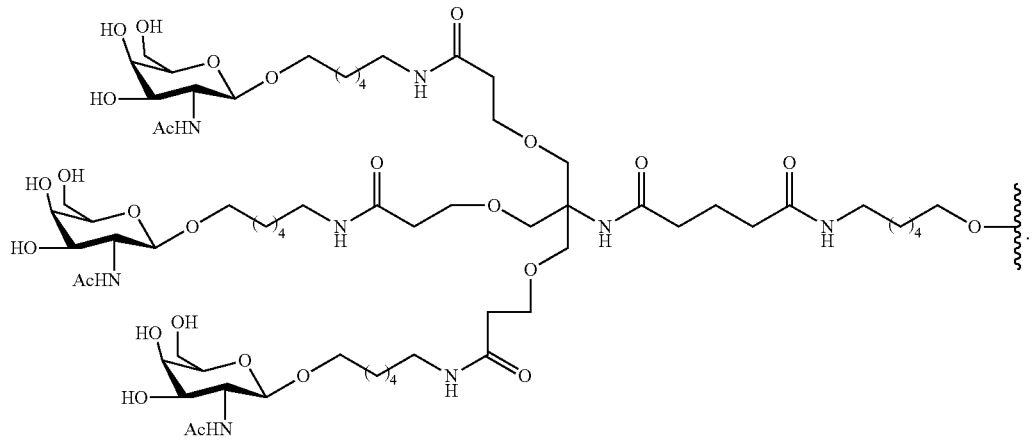

11. The compound of claim 1, wherein the conjugate group comprises:

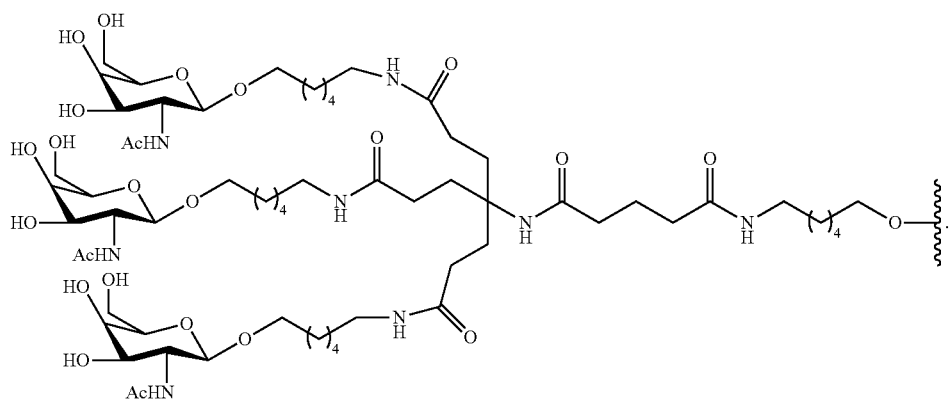

12. The compound of claim 1, wherein the conjugate group comprises at least one phosphorus linking group or neutral linking group.

13. The compound of claim 1, wherein the conjugate group comprises a cell-targeting moiety.

14. The compound of claim 13, wherein the cell-targeting moiety comprises:

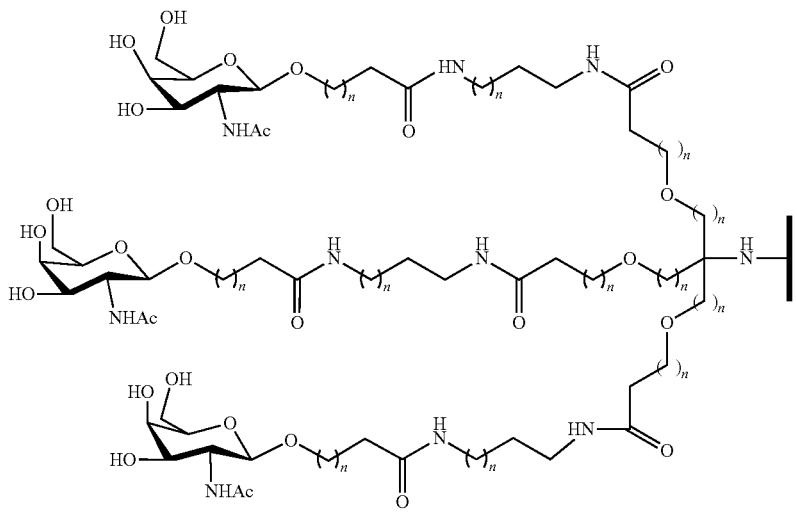

wherein each n is, independently, from 1 to 20.

15. The compound of claim 13, wherein the cell-targeting moiety comprises:

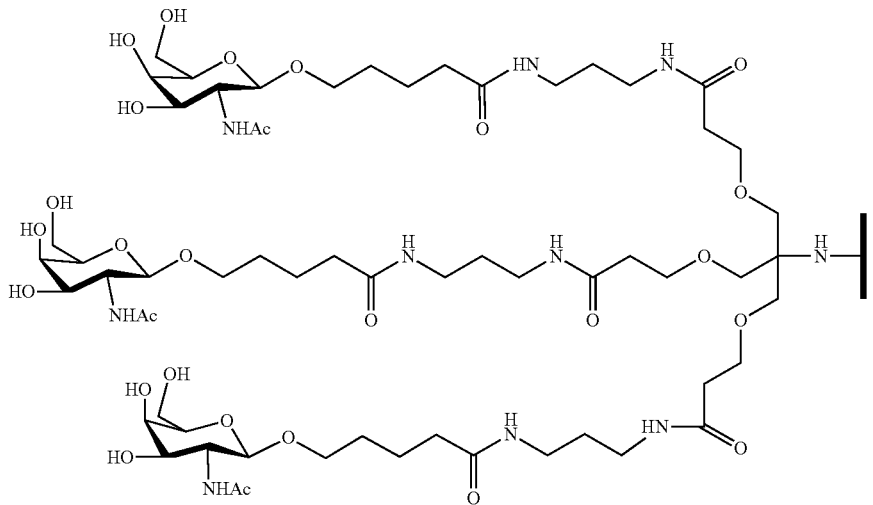

16. The compound of claim 13, wherein the cell-targeting moiety comprises:

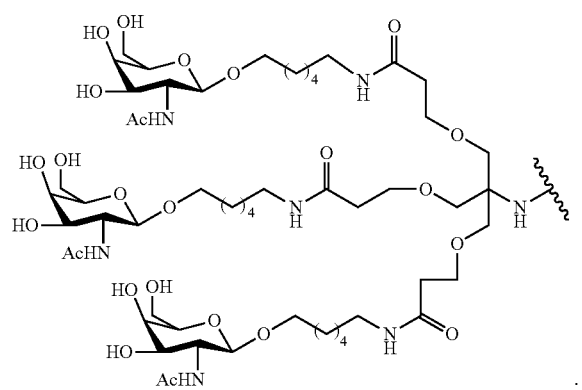

17. The compound of claim 1, wherein the conjugate group comprises a cleavable moiety selected from among: a phosphodiester, an amide, or an ester.

18. The compound of claim 1, wherein the conjugate group comprises a phosphodiester cleavable moiety.

19. The compound of claim 1, wherein the conjugate group does not comprise a cleavable moiety, and wherein the conjugate group comprises a phosphorothioate linkage between the conjugate group and the oligonucleotide.

20. The compound of claim 1, wherein the conjugate group comprises an amide cleavable moiety.

21. The compound of claim 1, wherein the conjugate group comprises an ester cleavable moiety.

22. A compound consisting of
(a) a conjugate group and
(b) a modified oligonucleotide of nucleobases of SEQ ID NO: 703 according to the following formula: mCes mCes Aes mCes mCes Tds Tds Tds Gds Gds Gds Tds Gds Ads Ads Tes Aes Ges mCes Ae; wherein, A=an adenine,
mC=a 5-methylcytosine
G=a guanine,
T=a thymine,
e=a 2'-O-methoxyethyl modified nucleoside,
d=a 2'-deoxynucleoside, and
s=a phosphorothioate internucleoside linkage.
23. A compound consisting of a conjugate group and a modified oligonucleotide of nucleobases of SEQ ID NO: 703 according to the following formula:
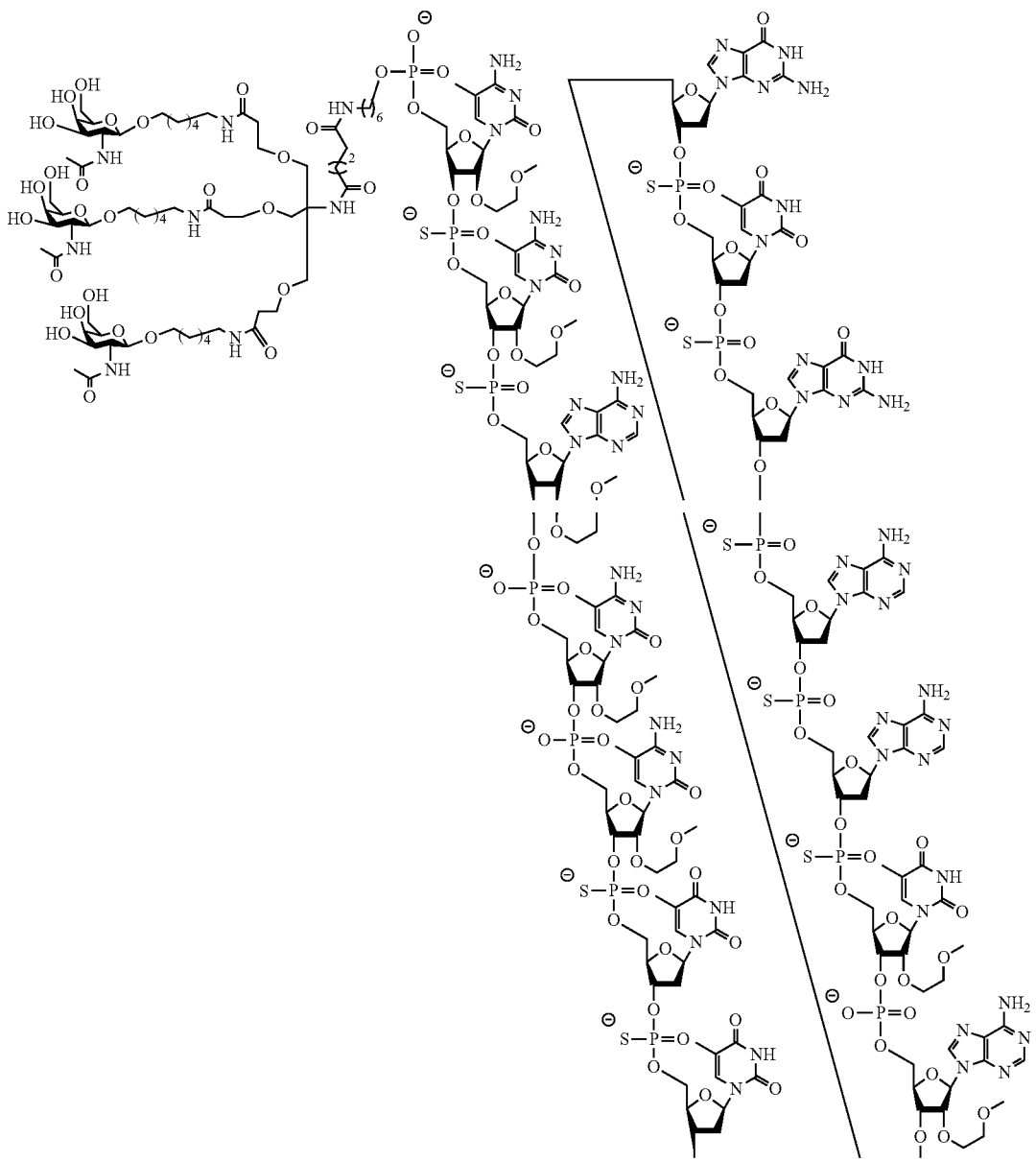

-continued

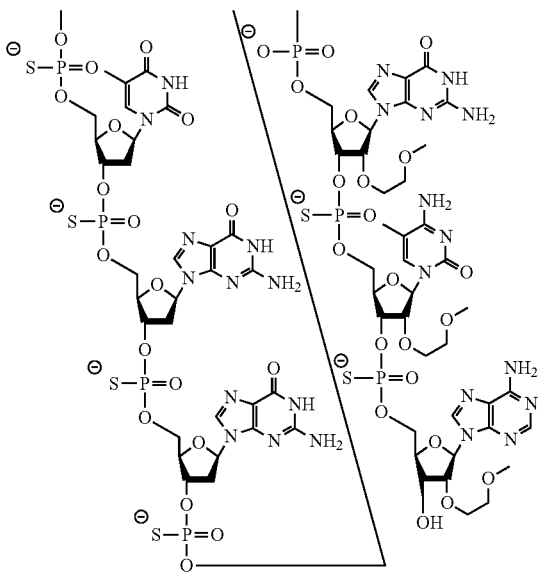

or a salt thereof.

24. A composition comprising the compound of claim 1 and at least one of a pharmaceutically acceptable carrier or diluent.

25. A prodrug comprising the compound of claim 1.

26. A composition comprising the compound of claim 23 and at least one of a pharmaceutically acceptable carrier or diluent.

27. A method comprising administering to an animal the compound or composition of claim 24.

28. The method of claim 27, wherein the animal is a human.

29. The method of claim 28, wherein the human has a disease associated with excess growth hormone.

30. The method of claim 29, wherein the disease associated with excess growth hormone is acromegaly.

31. The method of claim 29, wherein the administration reduces IGF-1 levels.

32. A method of reducing growth hormone receptor (GHR) levels in a human comprising administering to the human a therapeutically effective amount of the compound of claim 1, thereby reducing GHR levels in the human.

33. The method of claim 32, wherein the human has a disease associated with excess growth hormone.

34. The method of claim 33, wherein the disease associated with excess growth hormone is acromegaly.

35. A compound consisting of a modified oligonucleotide and a conjugate group, wherein the modified oligonucleotide is 20 linked nucleosides in length and consists of the sequence of SEQ ID NO: 703, wherein the modified oligonucleotide consists of
a gap segment consisting of ten linked deoxynucleosides;
a 5' wing segment consisting of five linked nucleosides; and
a 3' wing segment consisting of five linked nucleosides;
wherein the gap segment is positioned between the 5' wing segment and the 3' wing segment, wherein each nucleoside of each wing segment comprises a 2'-MOE sugar, wherein each internucleoside linkage is a phosphorothioate linkage; wherein each cytosine is a 5-methylcytosine; and wherein the conjugate group is

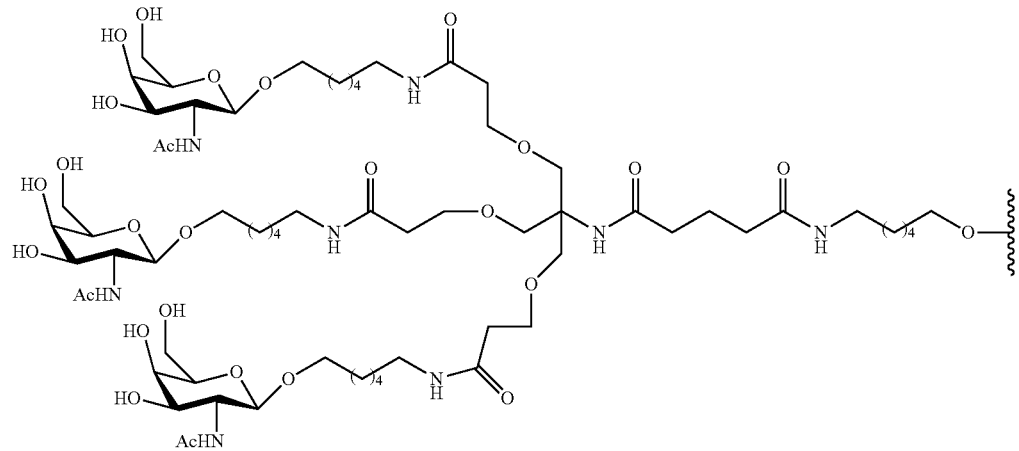

and is positioned at the 5'-end of the modified oligonucleotide.

36. The composition of claim 24, wherein the compound is a salt thereof.

37. The compound of claim 1, wherein the modified oligonucleotide is 16 to 30 linked nucleosides in length and wherein the modified oligonucleotide has a nucleobase sequence comprising a portion of at least 16 contiguous nucleobases 100% complementary to an equal length portion of nucleobases 153921-153940 of SEQ ID NO: 2.

38. The compound of claim 1, wherein the modified oligonucleotide is 17 to 30 linked nucleosides in length and wherein the modified oligonucleotide has a nucleobase sequence comprising a portion of at least 17 contiguous nucleobases 100% complementary to an equal length portion of nucleobases 153921-153940 of SEQ ID NO: 2.

39. The compound of claim 1, wherein the modified oligonucleotide is 18 to 30 linked nucleosides in length and wherein the modified oligonucleotide has a nucleobase sequence comprising a portion of at least 18 contiguous nucleobases 100% complementary to an equal length portion of nucleobases 153921-153940 of SEQ ID NO: 2.

40. The compound of claim 1, wherein the modified oligonucleotide is 19 to 30 linked nucleosides in length and wherein the modified oligonucleotide has a nucleobase sequence comprising a portion of at least 19 contiguous nucleobases 100% complementary to an equal length portion of nucleobases 153921-153940 of SEQ ID NO: 2.

41. The compound of claim 1, wherein the modified oligonucleotide is 20 to 30 linked nucleosides in length and wherein the modified oligonucleotide has a nucleobase sequence comprising 20 contiguous nucleobases 100% complementary to an equal length portion of nucleobases 153921-153940 of SEQ ID NO: 2.

42. The compound of claim 35, wherein the compound is a salt thereof.

43. A compound comprising a modified oligonucleotide, wherein the modified oligonucleotide is 20 linked nucleosides in length and consists of the sequence of SEQ ID NO: 703, wherein the modified oligonucleotide consists of
    a gap segment consisting of ten linked deoxynucleosides;
    a 5' wing segment consisting of five linked nucleosides; and
    a 3' wing segment consisting of five linked nucleosides;
wherein the gap segment is positioned between the 5' wing segment and the 3' wing segment, wherein each nucleoside of each wing segment comprises a 2'-MOE sugar, wherein each internucleoside linkage is a phosphorothioate linkage; and wherein each cytosine is a 5-methylcytosine.

\* \* \* \* \*